United States Patent 12,012,607 (ENGINEERING WHEAT WITH INCREASED DIETARY FIBER) - sequence listing, part 2

SEQ ID NO: 7591 - DNA, 462 bp, Artificial; identical to SEQ ID NO: 7384
  TaSBEIIa allele with mutations introduced by TALEN pair TaSBEIIa_T02
  misc_feature (234): n is a or c or t or g

SEQ ID NO: 7592 - DNA, 466 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcataaacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctaccgctactttcgctcattttgaattaaggtcctttcgtcatgcaaatttggggaacatcaaagagacaaagactagggaccactatttcttacagttccctcatggtctgagaatatgctggga

SEQ ID NO: 7593 - DNA, 468 bp, Artificial
  TaSBEIIa allele with mutations introduced by TALEN pair TaSBEIIa_T02
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattaaacaatcactgatggtgtaaccaaaggagttaaggaactagtcgtgggggagaaaccgcgagttgtcccaaaaccaggagatgggcagaaaatatacgagattgacccaacactgaaagattttcggagccatcttgactaccggtaatgcctaccgctgctttcgctcattttgaattaaggtcctttcatcatgcaaatttggggaacatcaaagagacaaagactagggaccaccatttcatacagatcccctgtggtctgagaatatgctggga

SEQ ID NO: 7594 - DNA, 507 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgccaggcccacggcttgaccccccagcaggtggtggccaaacaatcactgatggtgtaaccaaaggagttaaggaactagtcgtgggggagaaaaccgcgagttgtccaaaaccaggagatgggcagaaaatatacgagattgacccaacgctgaaagattttcggagccaatcttgactaccggtaatgcctacccgctactttcgctcattttgaattaaggtcctttcgtcatgcaaatttggggaacatcaaagagacaaagactagggacactatttcttacagttccctcatggtctgagaatactgctggga

SEQ ID NO: 7595 - DNA, 465 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcataaacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttgggaacatcaaagagacaaagactagggaccactattcttacagttccctcatggtctgagaatatgctggga

SEQ ID NO: 7596 - DNA, 511 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaaacttgaatcttcagaaccgactcaaggcatagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcgtgtaaccaaaggagttaaggaactagtcgtgggggagaaaccgcgagttgtcccaaaccaggagatggggcagaaaatatacgagattgacccaacgctgaaagattttcggagccatcttgactaccggtaatgcctacccgcctactttcgctcattttcgaattaggtaccttttcg

SEQ ID NO: 7597 - DNA, 507 bp, Artificial
  TaSBEIIa allele with mutations introduced by TALEN pair TaSBEIIa_T02
  misc_feature (387): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcagcgttaagccaacacccggcagcgttagggaccgtcgctgtcaacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgntactttcgctcattttgaattaaggtcctttcgtcatgcaaatttggggaacatcaaagagacaaagactagggaccactatttctacagttcccctcatggtctgagaatatgctggga

SEQ ID NO: 7598 - DNA, 461 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattaatcactgatggtgtaaccaaaggagttaaggaactagtacgtgggggagaaaccgcgagttgtcccaaaaccaggagatgggcagaaaatatacgagattgacccaacgctgaaagattttcggagccatcttgactaccggaatgcctaccgctactttcgctcatttgaattaaggtcctttcgtcatgcaaatttgggaacatcaaagagacaaagactagggaccactatttcttacagttcccctcatggtctgagaatatgctgga

SEQ ID NO: 7599 - DNA, 512 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcatttagcagagcgaggtatgtaggcggtgctacagagttcttgaagtgaacaatcactgatggtgtaaccaaaggagttaaggaactagtcgtgggggagaaaccgcgagttgtcccaaaaaccaggagatgggcagaaaatatacgagattgacccaacgctgaaagattttcggagccatcttgactaccggtaatgctacccgctactttcgctcatttgaattaaggtccttcgtcatgcaaatttggggaacatcaaagagacaaagactagggaccactattcttacagttcccctcatggtctgagtaatatagctggga

SEQ ID NO: 7600 - DNA, 507 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcagcgttaagccaacacccggcagcgttagggaccgtcgctgtcaacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtctttcgtcatgcaaatttggggaacatcaaagagacaaagactagggaccactatttcttacagttcccctcatggtctgagaatatgctggga

SEQ ID NO: 7601 - DNA, 469 bp, Artificial
  TaSBEIIa allele with mutations introduced by TALEN pair TaSBEIIa_T02
  misc_feature (447): n is a or c or t or g
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgcaatcactgatggtgtaaccaaaggagttaaggaactagtcgcgggggagaaaccgcgagttgtcccaaaaccaggagatgggcagaaaatatacgagattgacccaacgctgaaagattttcggagccatcttgactaccggtaatgcctacccgctaattcgctcattttgaattaaggtcctttcatcatgcaaatttggggaacatcaaagaggcaaagactagggaccactatttcatacagttcccctnatggtctgagaatatgctggga

SEQ ID NO: 7602 - DNA, 466 bp, Artificial
  TaSBEIIa allele with mutations introduced by TALEN pair TaSBEIIa_T02
  misc_feature (241): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattaaacaatcactgatggtgtaaccaaaggagttaaggaactagtcgtggggganaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaatttgggaacatcaaagagacaaagactagggaccactattcttacagttcccctcatggtctgagaatatgctggga

SEQ ID NO: 7603 - DNA, 464 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcataacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaatttgggaacatcaaagagacaaagactagggaccactatttcttacagttccctcatggtctgagaatatgctggga

SEQ ID NO: 7604 - DNA, 507 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgccaggcccacggcttgacccccccagcaggtggtggccaaacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagatatgctggga

SEQ ID NO: 7605 - DNA, 465 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattaaacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcatttgaattaaggtccttcgtcatgcaaatttgggaacatcaaagagacaaagactagggaccactattcttacagttcccctcatggtctgagaatatgctggga

SEQ ID NO: 7606 - DNA, 473 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggggactgcagaaaaacttgaatcttcagaaccgactcaaggcattaaacaatcactgatggtgtaaccaaaggagttaaggaactagtcgtgggggagaaaccgcgagttgtcccaaaaccaggagatgggcagaaaatatacgagattgacccaacgctgaaaagattttcggaagccatcttgactaccggtaatgcctacccgctactttcgctcattttgaattaaggtccttttcgtcactgcaaatttgggaacatcaaagagaacaaagactagggaccactatttcttacagttccctcatggtctgagaatatgctggga

SEQ ID NO: 7607 - DNA, 518 bp, Artificial
  TaSBEIIa allele with mutations introduced by TALEN pair TaSBEIIa_T02
  misc_feature (89); (208); (495): n is a or c or t or g
tcagatggatgtgcattctagcaagaacttcacaaaataatgcactgtttgtggtttcgtttgtctgctctacgattgctatttttcgngtgctgtagatacctgaagatatcgaggagcaaacggctgaagtgaacatgacaggggggaccgcagagaaacttgaatcttcagaaccgactcagggcattgcacgaaccccccgttnagcccgaccgctgcgccttatccggtaactaaacaatcactgatggtgtaaccaaaggagttaaggaactagtcgacgggggagaaaccgcgagttgtcccaaaaccaggagatgggcagaaaatatacgagattggacccaacgctgaaagatttcggagccatcttgactaccggtaatgcctaccgctaattcgctcatttgattaaggtcctttcatcatgcaaatttggggaacatcaaagaggcaaagactagggaccacgtatttcatacagttcccctnactggtctgagaatatgctggga

SEQ ID NO: 7608 - DNA, 466 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcataaacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttgggaacatcaaagagacaaagactagggaccactattcttacagttcccctcatggtctgagaatatgctggga

SEQ ID NO: 7609 - DNA, 515 bp, Artificial
  TaSBEIIa allele with mutations introduced by TALEN pair TaSBEIIa_T02
  misc_feature (348); (370): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattatgccatccgtaagatgcttttctgtgactggtgagtactcaaccaagtcattaaaattcgtgcacacagcccagcttggagcgaacgacctacaccgaactgagatacctaatcactgatggtgtaaccaaaggagttaaggaactagtcgtggggganaaaccgcgagttgtccaaaacnggagatgggcagaaatatacgagattgacccaacgctgaaagatttcggagccatctgactacggtaatgcctaccgctacttcgctcattttgaattaaggtcctttcgtcatgacaaatttcggggaactatactaaagaacg

SEQ ID NO: 7610 - DNA, 465 bp, Artificial; identical to SEQ ID NO: 7495
  TaSBEIIa allele with mutations introduced by TALEN pair TaSBEIIa_T02

SEQ ID NO: 7611 - DNA, 465 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcatacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattcttacagttcccctcatggtctgagaatatgctggga

SEQ ID NO: 7612 - DNA, 349 bp, Artificial
  TaSBEIIa allele with mutations introduced by TALEN pair TaSBEIIa_T02
  misc_feature (214): n is a or c or t or g
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatggacagggggggaccgcaagtagaaacttgaatcttaccagaaccgacttcagggcattacaatcactgatggtntaaccaaggagttaaggactagtcgcgggggagaaaccgcgagttgtcccaaaaccgaggagatgggcagaaaatatacgagattgacccaacgctagaaagattttcggagtccatcttgacgtaccggtaatg

SEQ ID NO: 7613 - DNA, 356 bp, Artificial
  TaSBEIIa allele with mutations introduced by TALEN pair TaSBEIIa_T02
tcagatggatgtgcattctagcaagaactccacgaaataatgcactgtttgtggtttcgttagtctgctctacaattgctatttcgtgctgtagatacctgaagacatcgaggagcaaacggctgaagtaaacatgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7614 - DNA, 199 bp, Artificial
  TaSBEIIa allele with mutations introduced by TALEN pair TaSBEIIa_T02
tcagatggatgtgcattctagcaagaacttcacgaaatgatttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7615 - DNA, 197 bp, Artificial
  TaSBEIIa allele with mutations introduced by TALEN pair TaSBEIIa_T02
tcagatggatgtgcattctagcaagaacttcacgaatgatttcggagccatcttgactaccggtaatgcctaccgctactttcgctcattttgaattaaggtcctttcgtcatgcaaatttggggaacatcaaagagacaaagactagggaccactatttcttacagttcccctcatggtctgagaatatgctggga

SEQ ID NO: 7616 - DNA, 198 bp, Artificial
  TaSBEIIa allele with mutations introduced by TALEN pair TaSBEIIa_T02
tcagatggatgtgcattctagcaagaacttcacgaatgatttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7617 - DNA, 196 bp, Artificial
  TaSBEIIa allele with mutations introduced by TALEN pair TaSBEIIa_T02
tcagatggatgtgcattctagcaagaacttcacgaatgatttcggagccatcttgactaccggtaatgcctaccgctactttcgctcattttgaattaaggtccttcgtcatgcaaatttggggaacatcaaagagacaaagactagggaccactatttcttacagttcccctcatggtctgagaatatgctggga

SEQ ID NO: 7618 - DNA, 340 bp, Artificial
  TaSBEIIa allele with mutations introduced by TALEN pair TaSBEIIa_T02
tcagatggatgtgcattctagcaagaacttcacgaataatgcactgtttgtggtttcgttagtctgctctacaattgctatttcgtgctgtagatacctgaagacatcgaggagaaaccgcgagttgtcccaaaccaggagatgggcagaaaatatacgagattgacccaacgctgaaagattttcggagccatcttgactaccggtaatgcctaccgctactttcgctcattttgaattaaggtcctttcgtcatgcaaatttggggaacatcaaagagacaaagactagggaccactatttcttacagttcccctcatggtctgagaatatgctggga

SEQ ID NO: 7619 - DNA, 272 bp, Artificial
  TaSBEIIa allele with mutations introduced by TALEN pair TaSBEIIa_T02
tcagatggatgtgcattctagcaagaacttcacaaataatgcactgtttgtggtttcgtttgtctgctctacgagatgggcagaaatatacgagattgacccaacgctgaagatttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 7620 - DNA, 190 bp, Artificial
  TaSBEIIa allele with mutations introduced by TALEN pair TaSBEIIa_T02
tcagatggatgtgcattctagcaagaacttcacgaatgatttcggagccatcttgactaccggtaatgcctaccgctacttcgctcatttgaattaaggtccttcgtcatgcaaatttgggaacatcaaagagacaaagactagggaccactattcttacagttccctcatggtctgagaatatgctgga

SEQ ID NO: 7621 - DNA, 338 bp, Artificial
  TaSBEIIa allele with mutations introduced by TALEN pair TaSBEIIa_T02
tcagatggatgtgcattctagcaagaacttcacgaataatgcactgtttgtggttcgttagtctgctctacaattgctatttcgtgctgtagatacctgaagacatcgaggagaaaccgcgagttgtcccaaaccaggagatgggcagaaaatatacgagattgacccaacgctgaaagatttcggagccatcttgactaccggtaatgcctaccgctactttcgctcattttgaattaaggtcctttcgtcatgcaaatttggggaacatcaaagagacaaagactagggaccactatttcttacagttcccctcatggtctgagaatatgctggga

SEQ ID NO: 7622 - DNA, 200 bp, Artificial
  TaSBEIIa allele with mutations introduced by TALEN pair TaSBEIIa_T02
tcagatggatgtgcattctagcaagaacttcacgaaatgattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7623 - DNA, 200 bp, Artificial; identical to SEQ ID NO: 7622
  TaSBEIIa allele with mutations introduced by TALEN pair TaSBEIIa_T02

SEQ ID NO: 7624 - DNA, 317 bp, Artificial
  TaSBEIIa allele with mutations introduced by TALEN pair TaSBEIIa_T02
tcagatggatgtgcattctagcaagaacttcacaacataatgcaccgtttggggtttcgtcagtctgctctacaattgctattttcgtgctgtagatagttgtcccaaaaccaggagatgggcagaaaatatacgagattgacccaacactgaaagattttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 7625 - DNA, 200 bp, Artificial; identical to SEQ ID NO: 7622
  TaSBEIIa allele with mutations introduced by TALEN pair TaSBEIIa_T02

SEQ ID NO: 7626 - DNA, 200 bp, Artificial; identical to SEQ ID NO: 7622
  TaSBEIIa allele with mutations introduced by TALEN pair TaSBEIIa_T02

SEQ ID NO: 7627 - DNA, 200 bp, Artificial; identical to SEQ ID NO: 7622
  TaSBEIIa allele with mutations introduced by TALEN pair TaSBEIIa_T02

SEQ ID NO: 7628 - DNA, 199 bp, Artificial; identical to SEQ ID NO: 7614
  TaSBEIIa allele with mutations introduced by TALEN pair TaSBEIIa_T02

SEQ ID NO: 7629 - DNA, 198 bp, Artificial; identical to SEQ ID NO: 7616
  TaSBEIIa allele with mutations introduced by TALEN pair TaSBEIIa_T02

SEQ ID NO: 7630 - DNA, 200 bp, Artificial; identical to SEQ ID NO: 7622
  TaSBEIIa allele with mutations introduced by TALEN pair TaSBEIIa_T02

SEQ ID NO: 7631 - DNA, 200 bp, Artificial; identical to SEQ ID NO: 7622
  TaSBEIIa allele with mutations introduced by TALEN pair TaSBEIIa_T02

SEQ ID NO: 7632 - DNA, 190 bp, Artificial
  TaSBEIIa allele with mutations introduced by TALEN pair TaSBEIIa_T02
tcagatggatgtgcattctagcaagaacttcacaacgagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 7633 - DNA, 190 bp, Artificial; identical to SEQ ID NO: 7632
  TaSBEIIa allele with mutations introduced by TALEN pair TaSBEIIa_T02

SEQ ID NO: 7634 - DNA, 200 bp, Artificial; identical to SEQ ID NO: 7622
  TaSBEIIa allele with mutations introduced by TALEN pair TaSBEIIa_T02

SEQ ID NO: 7635 - DNA, 451 bp, Artificial
  TaSBEIIa allele with mutations introduced by TALEN pair TaSBEIIa_T02
tcagatggatgtgcattctagcaagaacttcacaacataatgcaccgtttggggtttcgtcagtctgctctacaattgctattttcgtgctgtagatacctgaagatatcgaggagcaaacggcggaagtgaacatgacaggggggactgcagagaaacttcaatcttcagaaacaatcactgatggtgtaaccaaaggagttaaggaactagtcgtgggggagaaaccgcgagttgtcccaaaaaccaggagatgggcagaaaatatacgagattgacccaacactgaaagattttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatattggga

SEQ ID NO: 7636 - DNA, 200 bp, Artificial; identical to SEQ ID NO: 7622
  TaSBEIIa allele with mutations introduced by TALEN pair TaSBEIIa_T02

SEQ ID NO: 7637 - DNA, 412 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatctgaactagtcgtggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7638 - DNA, 366 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttgggaacatcaaagagacaaagactagggaccactatttcttacagttcccctcatggtctgagaatatgctggga

SEQ ID NO: 7639 - DNA, 274 bp, Artificial
  TaSBEIIa allele with mutations introduced by TALEN pair TaSBEIIa_T02
tcagatggatgtgcattctagcaagaacttcacaaataatgcactgtttgtggtttcgtttgtctgctctacgagatgggcagaaaatatacgagattgacccaacgctgaaagatttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 7640 - DNA, 333 bp, Artificial
  TaSBEIIa allele with mutations introduced by TALEN pair TaSBEIIa_T02
tcagatggatgtgcattctagcaagaacttcacgaaataatgcactgtttgtggtttcgtcagtctgctctacaattgctattttcgtgctgtagatacctgaagatatcgaggagcaaacggcggaagtgaacatgacaggggggactgcagagaaacttcgggcagaaaatatacgagatccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 7641 - DNA, 190 bp, Artificial; identical to SEQ ID NO: 7632
  TaSBEIIa allele with mutations introduced by TALEN pair TaSBEIIa_T02

SEQ ID NO: 7642 - DNA, 200 bp, Artificial; identical to SEQ ID NO: 7622
  TaSBEIIa allele with mutations introduced by TALEN pair TaSBEIIa_T02

SEQ ID NO: 7643 - DNA, 340 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagaaaccgcgagttgtcccaaaaccaggagatgggcagaaaatatacgagattgacccaacgctgaaagattttcggagccatcttgactaccggtaatgcctaccgctactttcgctcatttgaattaaggtcctttcgtcatgcaaatttggggaacatcaaagagacaaagactagggaccactattcttacagttccctcatggtctgagaataagctggga

SEQ ID NO: 7644 - DNA, 273 bp, Artificial
  TaSBEIIa allele with mutations introduced by TALEN pair TaSBEIIa_T02
tcagatggatgtgcattctagcaagaacttcacaaataatgcactgtttgtggtttcgtttgtctgctctacgagatgggcagaaaatatacgagattgacccaacgctgaaagatttcggagccatcttgactaccggtaatgcctacccgctaatttcgctcattttgaattaaggtcctttcatcatgcaaatttggggaacatcaaagaggcaaagactagggaccactatttcatacagttccctcatggtctgagaatatgctggga

SEQ ID NO: 7645 - DNA, 457 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagatatgctggga

SEQ ID NO: 7646 - DNA, 344 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaatatacgagattgacccaacgctgaaagattttcggagccatcttgactaccggtaatgcctaccgctactttcgctcattttgaattaaggtcctttcgtcatgcaaatttggggaacatcaaagagacaaagactagggaccactatttcttacagttcccctcatggtctgagaatatgctggga

SEQ ID NO: 7647 - DNA, 367 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7648 - DNA, 200 bp, Artificial; identical to SEQ ID NO: 7622
  TaSBEIIa allele with mutations introduced by TALEN pair TaSBEIIa_T02

SEQ ID NO: 7649 - DNA, 200 bp, Artificial; identical to SEQ ID NO: 7622
  TaSBEIIa allele with mutations introduced by TALEN pair TaSBEIIa_T02

SEQ ID NO: 7650 - DNA, 451 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaacttgaatcttcggaaacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7651 - DNA, 341 bp, Artificial
  TaSBEIIa allele with mutations introduced by TALEN pair TaSBEIIa_T02
tcagatggatgtgcattctagcaagaacttcacgaaataatgcactgttgtggtttcgttagtctgctctacaattgctatttcgtgctgtagatacctgaagacatcgaggagaaaccgcgagttgtcccaaaaccaggagatgggcagaaaatatacgagattgacccaacgctgaaagattttcggagccatcttgactaccggtaatgcctaccgctactttcgctcattttgaattaaggtcctttcgtcatgcaaatttggggaacatcaaagagacaaagactagggaccactatttcttacagttcccctcatggtctgagaatatgctggga

SEQ ID NO: 7652 - DNA, 274 bp, Artificial
  TaSBEIIa allele with mutations introduced by TALEN pair TaSBEIIa_T02
tcagatggatgtgcattctagcaagaacttcacaaataatgcactgtttgtggtttcgtttgtctgctctacgagatgggcagaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 7653 - DNA, 344 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7654 - DNA, 190 bp, Artificial
  TaSBEIIa allele with mutations introduced by TALEN pair TaSBEIIa_T02
tcagatggatgtgcattctatcaagaacttcacaacgagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 7655 - DNA, 416 bp, Artificial
  TaSBEIIa allele with mutations introduced by TALEN pair TaSBEIIa_T02
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacagggggactgcagagaaacttcaatcttcagaaccagtcgtgggggagaaaccgcgagttgtcccaaaaccaggagatgggcagaaaatatacgagattgacccaacactgaaagattttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 7656 - DNA, 273 bp, Artificial
  TaSBEIIa allele with mutations introduced by TALEN pair TaSBEIIa_T02
tcagatggatgtgcattctagcaagaacttcacaaataatgcactgtttgtggtttcgttgtctgctctacgagatgggcagaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 7657 - DNA, 376 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7658 - DNA, 321 bp, Artificial
  TaSBEIIa allele with mutations introduced by TALEN pair TaSBEIIa_T02
tcagatggatgtgcattctagcaagaacttcacaaataatgcactgttgtggtttcgttgtctgctctacgattgctattttcgtgtgctgtagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttgggaacatcaaagaggcaaagactagggaccactatttcatacagttcccctcatggtctgagaatatgctggga

SEQ ID NO: 7659 - DNA, 439 bp, Artificial
  TaSBEIIa allele with mutations introduced by TALEN pair TaSBEIIa_T02
  misc_feature (318): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcactgatggtgtaaccaaaggagttaaggaactagtcgtgggggagaaaccgcgagttgtcccaaaaacaggagatgggcagaaaatatacgagattgacccaacgctgaaagattttcggagccatcttgactaccggtaatgcctacccgntactttcgctcattttgaattaaggtcctttcgtcatgcaaatttggggaacatcaaagagacaaagactagggaccactatttcttacagttcccctcatggtctgagaatatgctggga

SEQ ID NO: 7660 - DNA, 376 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtgaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7661 - DNA, 344 bp, Artificial; identical to SEQ ID NO: 7653
  TaSBEIIa allele with mutations introduced by TALEN pair TaSBEIIa_T02

SEQ ID NO: 7662 - DNA, 190 bp, Artificial; identical to SEQ ID NO: 7632
  TaSBEIIa allele with mutations introduced by TALEN pair TaSBEIIa_T02

SEQ ID NO: 7663 - DNA, 419 bp, Artificial
  TaSBEIIa allele with mutations introduced by TALEN pair TaSBEIIa_T02
  misc_feature (397): n is a or c or t or g
tcagatggatgtgcattctagcaagaacttcacgaaataatgcactgtttgtggtttcgttagtctgctctacaattgccattttcgtgctgtagatacctgaagacatcgaggagcaaacggctgaagtaaacatgacaggggggactgcagaaaaacttgaatcttcagaaccgactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtccttcgtcatgcaaatttggggaacatcaaagagacaaagactagggaccactatttcttacagttcccctnatgtctgagaatatgcgtggga

SEQ ID NO: 7664 - DNA, 431 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggaactagtcgtgggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaattttggggaacatcaaagagacaaagactagggaccactatttcttacagttcccctcatggtctgagaatatgctggga

SEQ ID NO: 7665 - DNA, 451 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctaccgctactttcgctcattttgaattaaggtcctttcgtcatgcaaatttggggaacatcaaagagacaaagactagggaccactatttcttacagttccctcatggtctgagaatatgctggga

SEQ ID NO: 7666 - DNA, 344 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7667 - DNA, 462 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattcttacagttcccctcatggtctgagaatatgctggga

SEQ ID NO: 7668 - DNA, 381 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaaccgcgagttgtcccaaaaccaggagatgggcagaaaatatacgagattgacccaacgctgaaagattttcggagccatcttgactaccggtaatgcctacccgctactttcgctcatttgaattaaggtcctttcgtcatgcaaatttgggaacatcaaagagacaaagactagggaccactatttcttacagttcccctcatggtctgagaatatgctggga

SEQ ID NO: 7669 - DNA, 453 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaggtcctttcgtcatgcaaattttggggaacatcaaagagacaaagactagggaccactatttcttacagttcccctcatggtctgagatatgctggga

SEQ ID NO: 7670 - DNA, 448 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggtaaccaaaggagttaaggaactagtcgtgggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7671 - DNA, 418 bp, Artificial
  TaSBEIIa allele with mutations introduced by TALEN pair TaSBEIIa_T02
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccagtcgtgggggagaaaccgcgagttgtcccaaaaaccaggagaatgggcagaaaatatacgagattgacccaacactgaaagattttcggagccatcttgactaccggtaatgcctacccgctgctttcgctcattttgaattaaggtcctttcatcatgcaaatttggggaacatcaaagagacaaagactagggaccaccatttcatacagatccctcgtggtctgagaatatgctggga

SEQ ID NO: 7672 - DNA, 429 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7673 - DNA, 376 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7674 - DNA, 200 bp, Artificial; identical to SEQ ID NO: 7622
  TaSBEIIa allele with mutations introduced by TALEN pair TaSBEIIa_T02

SEQ ID NO: 7675 - DNA, 383 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaaattttggggaacatcaaagagacaaagactagggaccactatttcttacagttcccctcatggtctgagaatatgctggga

SEQ ID NO: 7676 - DNA, 200 bp, Artificial; identical to SEQ ID NO: 7622
  TaSBEIIa allele with mutations introduced by TALEN pair TaSBEIIa_T02

SEQ ID NO: 7677 - DNA, 391 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7678 - DNA, 341 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacaactagtcgtggggagaaaccgcgagttgtcccaaaaccaggagatgggcagaaaatatacgagattgacccaacgctgaaagattttcggagccatcttgactaccggtaatgcctacccgctactttcgctcatttgaattaaggtcctttcgtcatgcaaatttggggaacatcaaagagacaaagactagggaccactatttcttacagttccctcatggtctgagaatatgctggga

SEQ ID NO: 7679 - DNA, 410 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatctagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaattttggggaacatcaaaagagacaaagactagggaccactatttcttacagttcccctcatggtctgagaatatgctggga

SEQ ID NO: 7680 - DNA, 343 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattcttacagttcccctcatggtctgagaatatgctggga

SEQ ID NO: 7681 - DNA, 389 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttctacagttcccctcatggtctgagaatatgctggga

SEQ ID NO: 7682 - DNA, 200 bp, Artificial
  TaSBEIIa allele with mutations introduced by TALEN pair TaSBEIIa_T02
tcagatggatgtgcattctagcaagaacttcacgaaatgattttcggagccatcttgactaccggtaatgcctacccgctactttcgctcattttgaattaaggtcctttcatcatgcaaatttggggaacatcaaagaggcaaagactagggaccactatttcatacagttcccctcatggtctgagaatatgctggga

SEQ ID NO: 7683 - DNA, 382 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattcttacagttcccctcatggtctgagaatatgctggga

SEQ ID NO: 7684 - DNA, 436 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattcttacagttcccctcatggtctgagaatatgctggga

SEQ ID NO: 7685 - DNA, 385 bp, Artificial
  TaSBEIIa allele with mutations introduced by TALEN pair TaSBEIIa_T02
  misc_feature (362): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaaatttggggaacatcaaagagacaaaagactagggaccactatttcttacagttccccctnatggtctgagaatatgcgtggga

SEQ ID NO: 7686 - DNA, 429 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattggtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7687 - DNA, 450 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcataaccaaaggagttaaggaactagtcgtgggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7688 - DNA, 374 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggagaaaccgcgagttgtcccaaaaccaggagatgggcagaaaatatacgagattgacccaacgctgaaagattttcggagccatcttgactaccggtaatgcctacccgctactttcgctcattttgaattaaggtccttcgtcatgcaaatttggggaacatcaaagagacaaagactaggaccactatttcttacagttcccctcatggtctgagaatatgctggga

SEQ ID NO: 7689 - DNA, 343 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacaactagtcgtggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7690 - DNA, 465 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcatcaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7691 - DNA, 423 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaccaaaggagttaaggaactagtcgtgggggagaaaccgcgagttgtcccaaaaccaggagatgggcagaaaatatacgagattgacccaacgctgaaagattttcggagccatcttgactaccggtaatgcctaccgctactttcgctcattttgaattaaggtcctttcgtcatgcaaattttggggaacatcaaagagacaaagactagggaccactatttcttacagttcccctcatggtctgagaatatgctggga

SEQ ID NO: 7692 - DNA, 436 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggagttaaggaactagtcgtgggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttctacagttccctcatggtctgagaatatgctggga

SEQ ID NO: 7693 - DNA, 376 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7694 - DNA, 200 bp, Artificial; identical to SEQ ID NO: 7622
  TaSBEIIa allele with mutations introduced by TALEN pair TaSBEIIa_T02

SEQ ID NO: 7695 - DNA, 390 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7696 - DNA, 343 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacaactagtcgtggggagaaaccgcgagttgtcccaaaaccaggagatgggcagaaaatatacgagattgacccaacgctgaaagattttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 7697 - DNA, 200 bp, Artificial; identical to SEQ ID NO: 7622
  TaSBEIIa allele with mutations introduced by TALEN pair TaSBEIIa_T02

SEQ ID NO: 7698 - DNA, 463 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcactggtctgagaatatgctggga

SEQ ID NO: 7699 - DNA, 463 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaagggaacaatcactgatggtgtaaccaaaggagttaaggaactagtcgtggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagtcccctcatggtctgagaatatgctggga

SEQ ID NO: 7700 - DNA, 447 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctattttcgtgtgctgtagatacctgaagatatcgaggagcaaacggctgaagtgaacatgacaggggggaccgcagagaaacttgaatcttcaatcactgatggtgtaaccaaaggagttaaggaactagtcgcgggggagaaaccgcgagttgtcccaaaaaccaggagatgggcagaaaatatacgagattgacccaacgctgaaagattttcggagccatcttgactaccggtaatgcctacccgctaatttcgctcattttgaattaaggtcctttcatcatgcaaatttgggaacatcaaagaggcaaagactagggaccactatttcatacagttccctcatggtctgagaatatgctggga

SEQ ID NO: 7701 - DNA, 200 bp, Artificial; identical to SEQ ID NO: 7622
  TaSBEIIa allele with mutations introduced by TALEN pair TaSBEIIa_T02

SEQ ID NO: 7702 - DNA, 376 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactaaccgcgagttgtcccaaaaccaggagatgggcagaaaatatacgagattgacccaacactgaaagattttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 7703 - DNA, 392 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7704 - DNA, 437 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctattttcgtgtgctgtagatacctgaagatatcgaggagcaaacggctgaagtgaacatgacaggggggaccgcagagaaacttgaatcttcagaaccaaccaaaggagttaaggaactagtcgcgggggagaaaccgcgagttgccccaaaaccaggagatgggcagaaatatacgagattgacccaacgctgaaagatttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 7705 - DNA, 200 bp, Artificial; identical to SEQ ID NO: 7622
  TaSBEIIa allele with mutations introduced by TALEN pair TaSBEIIa_T02

SEQ ID NO: 7706 - DNA, 438 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttccctcatggtctgagaatatgctggga

SEQ ID NO: 7707 - DNA, 407 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaactgaactagtcgtgggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7708 - DNA, 190 bp, Artificial; identical to SEQ ID NO: 7632
  TaSBEIIa allele with mutations introduced by TALEN pair TaSBEIIa_T02

SEQ ID NO: 7709 - DNA, 502 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattcttacagttcccctcatggtctgagaatagtgactggacctaggacgactacgacgggaagtacgacacagggatagg

SEQ ID NO: 7710 - DNA, 408 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7711 - DNA, 420 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattcttacagttccctcatgtctgagatatgctggga

SEQ ID NO: 7712 - DNA, 200 bp, Artificial; identical to SEQ ID NO: 7622
  TaSBEIIa allele with mutations introduced by TALEN pair TaSBEIIa_T02

SEQ ID NO: 7713 - DNA, 383 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaaaccgcgagttgtcccaaaaccaggagatgggcagaaaatatacgagattgacccaacactgaaagattttcggagccatcttgactaccggtaatgcctacccgctgctttcgctcattttgaattaaggtcctttcatcatgcaaatttggggaacatcaaagagacaaagactagggaccaccatttcatacagatcccctgtggtctgagaatatgctggga

SEQ ID NO: 7714 - DNA, 200 bp, Artificial; identical to SEQ ID NO: 7622
  TaSBEIIa allele with mutations introduced by TALEN pair TaSBEIIa_T02

SEQ ID NO: 7715 - DNA, 370 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctattttcgtgtgctgtagatacctgaagatatcgaggagcaaacggctgaagtagtcgcggggagaaaccgcgagttgtcccaaaaccaggagatgggcagaaaatatacgagattgacccaacgctgaaagattttcggagccatcttgactaccggtaatgcctacccgctaatttcgctcatttgaattaaggtcctttcatcatgcaaatttgggaacatcaaagaggcaaagactagggaccactatttcatacagttcccctcatggtctgagaatatgctggga

SEQ ID NO: 7716 - DNA, 407 bp, Artificial
  TaSBEIIa allele with mutations introduced by TALEN pair TaSBEIIa_T02
tcagatggatgtgcatttagcaagaacttcacgaaataatgcactgtttgtggtttcgttagtctgctctacaattgctattttcgtgctgtagatacctgaagacatcgaggagcaaacggctgaagtaaacatgacaggggggactgcaaaggagttaaggaactagtcgtgggggagaaaccgcgagttgtcccaaaaccaggagatgggcagaaaatatacgagattgacccaacgctgaaagatttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7717 - DNA, 402 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctattttcgtgtgctgtagatacctgaagatatcgaggagcaaacggctgaagtgaacatgacaggggggaccgcagagaaacttgaatcttcagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaattttggggaacatcaaagaggcaaagactagggaccactatttcatacagttcccctcatggtctgagaatatgctggga

SEQ ID NO: 7718 - DNA, 199 bp, Artificial; identical to SEQ ID NO: 7614
  TaSBEIIa allele with mutations introduced by TALEN pair TaSBEIIa_T02

SEQ ID NO: 7719 - DNA, 458 bp, Artificial; identical to SEQ ID NO: 7407
  TaSBEIIa allele with mutations introduced by TALEN pair TaSBEIIa_T02

SEQ ID NO: 7720 - DNA, 200 bp, Artificial; identical to SEQ ID NO: 7622
  TaSBEIIa allele with mutations introduced by TALEN pair TaSBEIIa_T02

SEQ ID NO: 7721 - DNA, 376 bp, Artificial; identical to SEQ ID NO: 7660
  TaSBEIIa allele with mutations introduced by TALEN pair TaSBEIIa_T02

SEQ ID NO: 7722 - DNA, 200 bp, Artificial; identical to SEQ ID NO: 7622
  TaSBEIIa allele with mutations introduced by TALEN pair TaSBEIIa_T02

SEQ ID NO: 7723 - DNA, 422 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgggggagaaaccgcgagttgtcccaaaaaccaggagatgggcagaaaatatacgagattgacccaacgctgaaagattttcggagccatcttgactaccggtaatgcctacccgctacttcgctcattttgaattaaggtcctttgtcatgcaaatttggggaacatcaaagagacaaagactagggaccactatttcttacagttcccctcatggtctgagaatatgctggga

SEQ ID NO: 7724 - DNA, 190 bp, Artificial; identical to SEQ ID NO: 7632
  TaSBEIIa allele with mutations introduced by TALEN pair TaSBEIIa_T02

SEQ ID NO: 7725 - DNA, 457 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgggtgtaaccaaaggagttaaggaactagtcgtgggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7726 - DNA, 356 bp, Artificial
  TaSBEIIa allele with mutations introduced by TALEN pair TaSBEIIa_T02
tcagatgcatgtgcattctagcaagaacttcacgaaataatgcactgtttgtggtttcgttagtctgctctacaattgctattttcgtgctgtagatacctgaagacatcgaggagcaaacggctgaagtaaacatgagttgtcccaaaaccaggagatgggcagaaaatatacgagattgacccaacgctgaaagattttcggagccatcttgactaccggtaatgcctacccgctactttcgctcatttgaattaaggtcctttcgtcatgcaaatttggggaacatcaaagagacaaagactagggaccactatttcttacagttcccctcatggtctgagaatatgctggga

SEQ ID NO: 7727 - DNA, 413 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaaccaaaggagttaaggaactagtcgcgggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaattttggggaacatcaaagaggcaaagactagggaccactatttcatacagttcccctcatggtctgagaatatgctgggga

SEQ ID NO: 7728 - DNA, 452 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcggaaacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7729 - DNA, 401 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctattttcgtgtgctgtagatacctgaagatatcgaggagcaaacggctgaagtgaacatgacaggggggaccgcagagaaacttgaatcttcagaacccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 7730 - DNA, 190 bp, Artificial; identical to SEQ ID NO: 7632
  TaSBEIIa allele with mutations introduced by TALEN pair TaSBEIIa_T02

SEQ ID NO: 7731 - DNA, 344 bp, Artificial; identical to SEQ ID NO: 7666
  TaSBEIIa allele with mutations introduced by TALEN pair TaSBEIIa_T02

SEQ ID NO: 7732 - DNA, 367 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaaaccgcgagttgtcccaaaaccaggagatgggcagaaaatatacgagattgacccaacgctgaaagattttcggagccatcttgactaccggtaatgcctacccgctactttcgctcattttgtaattaaggtcctttcgtcatgcaaatttggggaacatcaaagagacaaagactagggaccactatttcttacagttccctcatggtctgagaatatgctggga

SEQ ID NO: 7733 - DNA, 343 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttccctcatggtctgagaatatgctggga

SEQ ID NO: 7734 - DNA, 457 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactattcatacagttcccctcatggtctgagaatatgctggga

SEQ ID NO: 7735 - DNA, 461 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttgggaacatcaaagagacaaagactagggaccactatttcttacagttcccctcatggtctgagaatatgctggga

SEQ ID NO: 7736 - DNA, 463 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggacaatcactgatggtgtaaccaaaggagttaaggaactagtcggtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattcttacagttcccctcatggtctgagaatatgctggga

SEQ ID NO: 7737 - DNA, 342 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacaactagtcgtgggggagaaaccgcgagttgtcccaaaaccaggagatgggcagaaaatatacgagattgacccaacgctgaaagattttcggagccatcttgactaccggtaatgcctacccgctactttcgctcatttgaattaaggtcctttcgtcatgcaaatttggggaacatcaaagagacaaagactagggaccactatttcttacagttccctcatggtctgagaatatgctggga

SEQ ID NO: 7738 - DNA, 367 bp, Artificial; identical to SEQ ID NO: 7647
  TaSBEIIa allele with mutations introduced by TALEN pair TaSBEIIa_T02

SEQ ID NO: 7739 - DNA, 375 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttgggaacatcaaagagacaaagactagggaccactatttcttacagttcccctcatggtctgagaatatgctggga

SEQ ID NO: 7740 - DNA, 391 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgagaaaccgcgagttgtcccaaaaccaggagatgggcagaaaatatacgagattgacccaacgctgaaagatttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7741 - DNA, 366 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattcttacagttcccctcatggtctgagaatatgctggga

SEQ ID NO: 7742 - DNA, 346 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7743 - DNA, 376 bp, Artificial; identical to SEQ ID NO: 7693
  TaSBEIIa allele with mutations introduced by TALEN pair TaSBEIIa_T02

SEQ ID NO: 7744 - DNA, 416 bp, Artificial
  TaSBEIIa allele with mutations introduced by TALEN pair TaSBEIIa_T02
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccagtcgtgggggagaaaccgcgagttgtcccaaaaaccaggagatgggcagaaaatatacgagattgacccaacactgaaagattttcggagccatcttgactaccggtaatgcctacccgctgctttcgctcattttgaattaaggtcctttcatcatgcaaatttggggaacatcaaagagacaaagactaggaccaccatttcatacagatccctcgtggtctgagaatatgctggga

SEQ ID NO: 7745 - DNA, 416 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttaaggaactagtcgtggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattcttacagttcccctcatggtctgagaatatgctggga

SEQ ID NO: 7746 - DNA, 434 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttggatggtgtaaccaaaggagttaaggaactagtcgtgggggagaaaccgcgagttgtcccaaaaccaggagatgggcagaaaaatatacgagattgacccaacgctgaaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7747 - DNA, 434 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttggatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcattgcaaattttggggaacatcaaagagacaaagactagggaccactatttcttacagttcccctcatggtctgagaatatgctggga

SEQ ID NO: 7748 - DNA, 456 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattcttacagttcccctcatggtctgagatatgctggga

SEQ ID NO: 7749 - DNA, 454 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcatggtgtaaccaaaggagttaaggaactagtcgtgggggagaaaccgcgagttgtcccaaaaaccaggagatgggcagaaaatatacgagattgacccaacgctgaaagattttcggagccatcttgactaccggtaatgcctacccgctactttcgctcattttgattaaggtcctttcgtcatgcaaatttggggaacatcaaagagacaaagactagggaccactattcttacagttacccctcatggtctgagaatatgctggga

SEQ ID NO: 7750 - DNA, 385 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctattttcgtgtgctgtagatacctgaagatatcgaggagcaaacggctgaagtgaacatgacaggggggaccgcagagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 7751 - DNA, 437 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7752 - DNA, 357 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7753 - DNA, 200 bp, Artificial; identical to SEQ ID NO: 7622
  TaSBEIIa allele with mutations introduced by TALEN pair TaSBEIIa_T02

SEQ ID NO: 7754 - DNA, 390 bp, Artificial; identical to SEQ ID NO: 7695
  TaSBEIIa allele with mutations introduced by TALEN pair TaSBEIIa_T02

SEQ ID NO: 7755 - DNA, 408 bp, Artificial; identical to SEQ ID NO: 7710
  TaSBEIIa allele with mutations introduced by TALEN pair TaSBEIIa_T02

SEQ ID NO: 7756 - DNA, 434 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaattttggggaacatcaaagagacaaagactagggaccactatttcttacagttcccctcatggtctgagaatatgctggga

SEQ ID NO: 7757 - DNA, 424 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7758 - DNA, 418 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7759 - DNA, 377 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaattttggggaaccatcaaagagacaaagctagggaccactatttcttacagttcccctcatggtctgagaatatgctggga

SEQ ID NO: 7760 - DNA, 325 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctatttttcgtgtgctgtagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttccctcatggtctgagaatatgctggga

SEQ ID NO: 7761 - DNA, 412 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaagttaaggaactagtcgcgggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 7762 - DNA, 408 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatctagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7763 - DNA, 391 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaaagagacaaagactagggaccactatttcttacagttcccctcatggtctgagaatatgctggga

SEQ ID NO: 7764 - DNA, 446 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactatggtgtaaccaaggagttaaggaactagtcgtgggggagaaaccgcgagttgtcccaaaaccaggagatgggcagaaaatatacgagattgacccaacgctgaaagattttcggagccatcttgactaccggtaatgcctaccgctactttcgctcattttgaattaaggtcctttcgtcatgcaaatttggggaacatcaaagagacaaagactagggaccactatttcttacagttcccctcatggtctgagaatatgctggga

SEQ ID NO: 7765 - DNA, 464 bp, Artificial
  TaSBEIIa allele with mutations introduced by TALEN pair TaSBEIIa_T02
  misc_feature (237): n is a or c or t or g
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgactgatggtgtaaccaaaggagttaaggaactagtcgcggggganaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttgggaacatcaaagaggcaaagactagggaccactatttcatacagttcccctcatggtctgagaatatgctggga

SEQ ID NO: 7766 - DNA, 462 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7767 - DNA, 488 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcacaatcactgatggtgtaaccaaaggagttaaggaactagtcgtgggggagaaaccgcgagttgtcccaaaaccaggagatgggcagaaaatatacgagattgacccaaacactgaaagattttcggagccatcttgactaccggtaatgcctacccgctgctttcgctcattttgaattaggtcctttcatcatgcaaatttggggaacatcaaagagacaaagactagggaccaccatttcatacagatcccctcgtggtctgagaatatgctgggactagactgccaaggcacacaggggatagg

SEQ ID NO: 7768 - DNA, 200 bp, Artificial; identical to SEQ ID NO: 7622
  TaSBEIIa allele with mutations introduced by TALEN pair TaSBEIIa_T02

SEQ ID NO: 7769 - DNA, 459 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctaccgctactttcgctcattttgaattaaggtcctttcgtcatgcaaatttggggaacatcaaagagacaaagactagggaccactatttcttacagttcccctcatggtctgagaatatgctggga

SEQ ID NO: 7770 - DNA, 460 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7771 - DNA, 416 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7772 - DNA, 366 bp, Artificial; identical to SEQ ID NO: 7638
  TaSBEIIa allele with mutations introduced by TALEN pair TaSBEIIa_T02

SEQ ID NO: 7773 - DNA, 343 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagaaaccgcgagttgtcccaaaaccaggagatgggcagaaaatatacgagattgacccaacgctgaaagattttcggagccatcttgactaccggtaatgcctacccgctactttcgctcatttgaattaaggtcctttcgtcatgcaaatttggggaacatcaaagagacaaagactagggaccactatttcttacagttcccctcatggtctgagaatatgctggga

SEQ ID NO: 7774 - DNA, 463 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7775 - DNA, 200 bp, Artificial; identical to SEQ ID NO: 7622
  TaSBEIIa allele with mutations introduced by TALEN pair TaSBEIIa_T02

SEQ ID NO: 7776 - DNA, 376 bp, Artificial; identical to SEQ ID NO: 7693
  TaSBEIIa allele with mutations introduced by TALEN pair TaSBEIIa_T02

SEQ ID NO: 7777 - DNA, 453 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7778 - DNA, 343 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacaactagtcgtgggggagaaaccgcgagttgtcccaaaaccaggagatgggcagaaaatatacgagattgacccaacgctgaaagattttcggagccatcttgactaccggtaatgcctaccgctgctttcgctcattttgaattaaggtcctttcatcatgcaaatttggggaacatcaaagagacaaagactagggaccaccatttcatacagatcccctcgtggtctgagaatatgctggga

SEQ ID NO: 7779 - DNA, 461 bp, Artificial
  TaSBEIIa allele with mutations introduced by TALEN pair TaSBEIIa_T02
  misc_feature (234): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcaatcactgatggtgtaaccaaaggagttaaggaactagtcgtggggganaaaccgcgagttgtcccaaaaccaggagatgggcagaaaatatacgagattgacccaacgctgaaagattttcggagccatcttgactaccggtaatgcctacccgctactttcgctcattttgaattaaggtccttcgtcatgcaaatttggggaacatcaaagagacaaagactagggaccactatttcttacagttcccctcatggtctgagaatatgctggga

SEQ ID NO: 7780 - DNA, 376 bp, Artificial; identical to SEQ ID NO: 7693
  TaSBEIIa allele with mutations introduced by TALEN pair TaSBEIIa_T02

SEQ ID NO: 7781 - DNA, 384 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7782 - DNA, 427 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattggtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttgggaacatcaaagagacaaagactagggaccactatttcttacagttccctcatggtctgagaatatgctggga

SEQ ID NO: 7783 - DNA, 394 bp, Artificial
  TaSBEIIa allele with mutations introduced by TALEN pair TaSBEIIa_T02
  misc_feature (372): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaattttggggaacatcaaagagacaaagactagggaccactatttcttacagttccccctnatggtctgagaatatgctggga

SEQ ID NO: 7784 - DNA, 376 bp, Artificial; identical to SEQ ID NO: 7660
  TaSBEIIa allele with mutations introduced by TALEN pair TaSBEIIa_T02

SEQ ID NO: 7785 - DNA, 344 bp, Artificial; identical to SEQ ID NO: 7653
  TaSBEIIa allele with mutations introduced by TALEN pair TaSBEIIa_T02

SEQ ID NO: 7786 - DNA, 460 bp, Artificial
  TaSBEIIa allele with mutations introduced by TALEN pair TaSBEIIa_T02
  misc_feature (233): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggaatcactgatggtgtaaccaaaggagttaaggaactagtcgtggggganaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagctagggaccactatttcttacagttcccctcatggtctgagaatatgctggga

SEQ ID NO: 7787 - DNA, 457 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgaacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgctaaatttggggaacatcaaagagacaaagactagggaccactatttcttacagttcccctcatggtctgagaatatgctggga

SEQ ID NO: 7788 - DNA, 457 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7789 - DNA, 365 bp, Artificial
  TaSBEIIa allele with mutations introduced by TALEN pair TaSBEIIa_T02
  misc_feature (306): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagngacaaagctagggaccactattcttacagttcccctcatggtctgagaatatgctggga

SEQ ID NO: 7790 - DNA, 422 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattcttacagttcccctcatggtctgagaatatgctggga

SEQ ID NO: 7791 - DNA, 457 bp, Artificial
  TaSBEIIa allele with mutations introduced by TALEN pair TaSBEIIa_T02
tcagatggatgtgcattctagcaagaacttcatgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctaccgctactttcgctcattttgaattaaggtcctttcgtcattgcaaatttggggaacatcaaagagacaaagactagggaccactattcttacagttcccctcatggtctgagaatatgctggga

SEQ ID NO: 7792 - DNA, 439 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaaggagttaaggaactagtcgtgggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7793 - DNA, 453 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctaccgctactttcgctcattttgaattaaggtcctttcgtcatgcaaattttggggaacatcaaagagacaaagactagggaccactatttcttacagttcccctcatggtctgagaatatgctggga

SEQ ID NO: 7794 - DNA, 462 bp, Artificial
  TaSBEIIa allele with mutations introduced by TALEN pair TaSBEIIa_T02
  misc_feature (233): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcatcactgatggtgtaaccaaaggagttaaggaactagtcgtggggganaaaccgcgagttgtcccaaaaccaggagatgggcagaaaatatacgagattgacccaacgctgaaagattttcggagccatcttgactaccggtaatgcctacccgctactttcgctcattttgaattaaggtccttttcgtcatgcaaatttggggaacatcaaagagacaaagactagggaccactatttcttacagttcccctcatggtctgagaatatgctggga

SEQ ID NO: 7795 - DNA, 200 bp, Artificial; identical to SEQ ID NO: 7622
  TaSBEIIa allele with mutations introduced by TALEN pair TaSBEIIa_T02

SEQ ID NO: 7796 - DNA, 438 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaaggagttaaggaactagtcgtgggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaatttgggaacatcaaagagacaaagactagggaccactatttcttacagttcccctcatggtctgagaatatgctggga

SEQ ID NO: 7797 - DNA, 438 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctaccgctactttcgctcattttgaattaaggtcctttcgtcatgcaaatttggggaacatcaaagagacaaagactagggaccactatttcttacagttcccctcatggtctgagaatatgctggga

SEQ ID NO: 7798 - DNA, 447 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcaccaaaggagttaaggaactagtcgtgggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7799 - DNA, 200 bp, Artificial; identical to SEQ ID NO: 7622
  TaSBEIIa allele with mutations introduced by TALEN pair TaSBEIIa_T02

SEQ ID NO: 7800 - DNA, 356 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttccctcatggtctgagaatatgctggga

SEQ ID NO: 7801 - DNA, 346 bp, Artificial
  TaSBEIIa allele with mutations introduced by TALEN pair TaSBEIIa_T02
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaaatatacgagattgacccaacgctgaaagattttcggagccatcttgactaccggtaatgcctaccgctaatttcgctcattttgaattaaggtcctttcatcatgcaaatttgggaacatcaaagaggcaaagactagggaccactatttcatacagttcccctcatggtctgagaatatgctggga

SEQ ID NO: 7802 - DNA, 392 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccaccatttcatacagatcccctcgtggtctgagaatatgctggga

SEQ ID NO: 7803 - DNA, 342 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaatatacgagattgacccaacgctgaaagattttcggagccatcttgactaccggtaatgcctacccgctactttcgctcatttgaattaaggtcctttcgtcatgcaaatttggggaacatcaaagagacaaagactaggaccactattcttacagttccctcatggtctgagaatatgctggga

SEQ ID NO: 7804 - DNA, 200 bp, Artificial; identical to SEQ ID NO: 7622
  TaSBEIIa allele with mutations introduced by TALEN pair TaSBEIIa_T02

SEQ ID NO: 7805 - DNA, 200 bp, Artificial; identical to SEQ ID NO: 7622
  TaSBEIIa allele with mutations introduced by TALEN pair TaSBEIIa_T02

SEQ ID NO: 7806 - DNA, 445 bp, Artificial
  TaSBEIIa allele with mutations introduced by TALEN pair TaSBEIIa_T02
  misc_feature (218); (243): n is a or c or t or g
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtgagttaaggactagtcgcggggganaaaccgcgagttgtcccaaaaaccnggagatgggcagaaatatacgagattgacccaacgctgaaagattttcggagccatcttgactaccggtaatgcctacccgctaatttcgctcattttgaattaaggttctttcatcatgcaaatttggggaacatcaaagaggcaaagactagggaccactattcatacagttcccctcatggtctgagaatatgctggga

SEQ ID NO: 7807 - DNA, 454 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattatggtgtaaccaaaggagttaaggaactagtcgtgggggagaaaccgcgagttgtcccaaaacaggagatgggcagaaaatatacgagattgacccaacgctgaaagattttcggagccatcttgactaccggtaatgcctacccgctgctttcgctcattttgaattaaggtcctttcatcatgcaaatttggggaacatcaaagagacaaagactaggaccaccattcatacagatcccctcgtggtctgagaatatgctggga

SEQ ID NO: 7808 - DNA, 325 bp, Artificial
  TaSBEIIa allele with mutations introduced by TALEN pair TaSBEIIa_T02
tcagatggatgtgcattctagcaagaacttcacaaataatgcactgtttgtggtttcgtttgtctgctctacgattgctatttttcgtgtgctgtagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 7809 - DNA, 388 bp, Artificial
  TaSBEIIa allele with mutations introduced by TALEN pair TaSBEIIa_T02
tcagatggatgtgcattctagcaagaacttcacgaataatgcactgtttgtggtttcgttagtctgctctacaattgctattttcgtgctgtagatacctgaagacatcgaggagcaaacggctgaagtaaacatgacagggggactgcagaaaaacttgagaaaccgcgagttgtcccaaaaccaggagatgggcagaaaatatacgagattgacccaacgctgaaagattttcggagccatcttgactaccggtaatgcctacccgctactttcgctcatttgaattaaggtccttcgtcatgcaaatttggggaacatcaaagagacaaagactagggaccactatttcttacagttcccctcatggtctgagaatatgctggga

SEQ ID NO: 7810 - DNA, 462 bp, Artificial; identical to SEQ ID NO: 7766
  TaSBEIIa allele with mutations introduced by TALEN pair TaSBEIIa_T02

SEQ ID NO: 7811 - DNA, 200 bp, Artificial; identical to SEQ ID NO: 7622
  TaSBEIIa allele with mutations introduced by TALEN pair TaSBEIIa_T02

SEQ ID NO: 7812 - DNA, 420 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7813 - DNA, 404 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaattagtcgtgggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaagaagacaaagactaggacactattcttacagttccctcatggtctgagaatatgctggga

SEQ ID NO: 7814 - DNA, 414 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttgggaacatcaaagagacaaagactagggaccactatttcttacagttcccctcatggtctgagaatatgctgga

SEQ ID NO: 7815 - DNA, 424 bp, Artificial; identical to SEQ ID NO: 7757
  TaSBEIIa allele with mutations introduced by TALEN pair TaSBEIIa_T02

SEQ ID NO: 7816 - DNA, 412 bp, Artificial; identical to SEQ ID NO: 7637
  TaSBEIIa allele with mutations introduced by TALEN pair TaSBEIIa_T02

SEQ ID NO: 7817 - DNA, 389 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaaaccgcgagttgtcccaaaaccaggagatgggcagaaaatatacgagattgacccaacgctgaaagattttcggagccatcttgactaccggtaatgcctacccgctactttcgctcattttgaattaaggtccttcgtcatgcaaatttggggaacatcaaagagacaaagactagggaccactatttcttacagttcccctcatggtctgagaatatgctggga

SEQ ID NO: 7818 - DNA, 455 bp, Artificial
  TaSBEIIa allele with mutations introduced by TALEN pair TaSBEIIa_T02
cagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattatggtgtaaccaaaggagttaaggaactagtcgtgggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaatttgggaacatcaaagagacaaagactagggaccactatttctacagttcccctcatggtctgagaatatgctggga

SEQ ID NO: 7819 - DNA, 366 bp, Artificial; identical to SEQ ID NO: 7741
  TaSBEIIa allele with mutations introduced by TALEN pair TaSBEIIa_T02

SEQ ID NO: 7820 - DNA, 401 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7821 - DNA, 429 bp, Artificial; identical to SEQ ID NO: 7672
  TaSBEIIa allele with mutations introduced by TALEN pair TaSBEIIa_T02

SEQ ID NO: 7822 - DNA, 200 bp, Artificial; identical to SEQ ID NO: 7622
  TaSBEIIa allele with mutations introduced by TALEN pair TaSBEIIa_T02

SEQ ID NO: 7823 - DNA, 276 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 7824 - DNA, 451 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagatatgctggga

SEQ ID NO: 7825 - DNA, 456 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttctacagttcccctcatggtctgagatatgctggga

SEQ ID NO: 7826 - DNA, 394 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacaaaggagttaaggaactagtcgcggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 7827 - DNA, 384 bp, Artificial; identical to SEQ ID NO: 7781
  TaSBEIIa allele with mutations introduced by TALEN pair TaSBEIIa_T02

SEQ ID NO: 7828 - DNA, 461 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttctacagttcccctcatggtctgagaatatgctggga

SEQ ID NO: 7829 - DNA, 412 bp, Artificial; identical to SEQ ID NO: 7761
  TaSBEIIa allele with mutations introduced by TALEN pair TaSBEIIa_T02

SEQ ID NO: 7830 - DNA, 367 bp, Artificial; identical to SEQ ID NO: 7647
  TaSBEIIa allele with mutations introduced by TALEN pair TaSBEIIa_T02

SEQ ID NO: 7831 - DNA, 461 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattcttacagttcccctcatggtctgagaatatgctggga

SEQ ID NO: 7832 - DNA, 430 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattggtcgtgggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7833 - DNA, 404 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaactgaactagtcgtggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctgga

SEQ ID NO: 7834 - DNA, 457 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7835 - DNA, 447 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactggtgtaaccaaaggagttaaggaactagtcgtgggggagaaaccgcgagttgtcccaaaaaccaggagatgggcagaaaaatatacgagattgacccaacgctgaaagattttcggagccatcttgactaccggtaatgcctaccgctactttcgctcattttgaattaaggtcctttcgtcatgcaaatttggggaacatcaaagagacaaagactagggaccactatttcttacagttcccctcatggtctgagaatatgctggga

SEQ ID NO: 7836 - DNA, 455 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcatggtgtaaccaaaggagttaaggaactagtcgtgggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7837 - DNA, 457 bp, Artificial
  TaSBEIIa allele with mutations introduced by TALEN pair TaSBEIIa_T02
  misc_feature (230): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgatggtgtaaccaaaggagttaaggaactagtcgtggggganaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattcttacagttcccctcatggtctgagaatatgctggga

SEQ ID NO: 7838 - DNA, 457 bp, Artificial; identical to SEQ ID NO: 7788
  TaSBEIIa allele with mutations introduced by TALEN pair TaSBEIIa_T02

SEQ ID NO: 7839 - DNA, 456 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttgggaacatcaaagagacaaagactagggaccactatttcttacagttcccctcatggtctgagaatatgctggga

SEQ ID NO: 7840 - DNA, 457 bp, Artificial; identical to SEQ ID NO: 7788
  TaSBEIIa allele with mutations introduced by TALEN pair TaSBEIIa_T02

SEQ ID NO: 7841 - DNA, 457 bp, Artificial
  TaSBEIIa allele with mutations introduced by TALEN pair TaSBEIIa_T02
  misc_feature (231): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcacaatcactgatggtgtaaccaaaggagttaaggaactagtcgtggggganaaaccgcgagttgtcccaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattcttacagttcccctcatggtctgagaatatgctggga

SEQ ID NO: 7842 - DNA, 200 bp, Artificial; identical to SEQ ID NO: 7622
  TaSBEIIa allele with mutations introduced by TALEN pair TaSBEIIa_T02

SEQ ID NO: 7843 - DNA, 424 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaattttgggaacatcaaagagacaaagactagggaccactatttcttacagttcccctcatggtctgagaatatgctggga

SEQ ID NO: 7844 - DNA, 346 bp, Artificial; identical to SEQ ID NO: 7742
  TaSBEIIa allele with mutations introduced by TALEN pair TaSBEIIa_T02

SEQ ID NO: 7845 - DNA, 345 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaatatacgagattgacccaacgctgaaagattttcggagccatcttgactaccggtaatgcctacccgctactttcgctcattttgaattaaggtcctttcgtcatgcaaatttgggaacatcaaagagacaaagactagggaccactatttcttacagttcccctcatggtctgagaatatgctggga

SEQ ID NO: 7846 - DNA, 466 bp, Artificial
  TaSBEIIa allele with mutations introduced by TALEN pair TaSBEIIa_T02
  misc_feature (239); (263): n is a or c or t or g
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcaggaaacaatcactgatggtgtaaccaaaggagttaaggaactagtcgcggggganaaaccgcgagttgtcccaaaaccnggagatgggcagaaaatatacgagattaacccaacgctgaaagattttcggagccatcttgactaccggtaatgcctacccgctaatttcgctcattttgaattaaggtcctttcatcatgcaaatttgggaacatcaaagaggcaaagactagggaccactatttcatacagttcccctcatggtctgagaatatgctggga

SEQ ID NO: 7847 - DNA, 424 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7848 - DNA, 200 bp, Artificial; identical to SEQ ID NO: 7622
  TaSBEIIa allele with mutations introduced by TALEN pair TaSBEIIa_T02

SEQ ID NO: 7849 - DNA, 439 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactaaaggagttaaggaactagtcgcgggggagaaaccgcgagttgtcccaaaaaccaggagatgggcagaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactattcatacagttcccctcatggtctgagaatatgctggga

SEQ ID NO: 7850 - DNA, 380 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattcttacagttcccctcatggtctgagaatatgctggga

SEQ ID NO: 7851 - DNA, 393 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaaaccgcgagttgtcccaaaaccaggagatgggcagaaaatatacgagattgacccaacgctgaaagattttcggagccatcttgactaccggtaatgcctacccgctactttcgctcattttgaattaaggtccttttcgtcatgcaaaattttggggaacatcaaagagacaaagactagggaccactatttcttacagttcccctcatggtctgagaatatgctggga

SEQ ID NO: 7852 - DNA, 438 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggagttaaggaactagtcgtgggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7853 - DNA, 436 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaatcactgatggtgtaaccaaaggagttaaggaactagtcgcgggggagaaaccgcgagttgtcccaaaaaccaggagatgggcagaaaatatacgagattgacccaacgctgaaagattttcggagccatcttgactaccggtaatgcctaccgctaatttcgctcattttgaattaaggtcctttcatcatgcaaatttggggaacatcaaagaggcaaagactagggaccactatttcatacagttcccctcatggtctgagaatatgctggga

SEQ ID NO: 7854 - DNA, 452 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7855 - DNA, 326 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctatttttcgtgtgctgtagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 7856 - DNA, 318 bp, Artificial
  TaSBEIIa allele with mutations introduced by TALEN pair TaSBEIIa_T02
tcagatggatgtgcattctagcaagaacttcacaacataatgcaccgtttggggtttcgtcagtctgctctacaattgctattttcgtgctgtagatagttgtcccaaaaccaggagatgggcagaaaatatacgagattgacccaacactgaaagattttcggagccatcttgactaccggtaatgcctacccgctgctttcgctcattttgaattaaggtcctttcatcatgcaaatttggggaacatcaaagagacaaagactagggaccaccatttcatacagactcccctcgtggtctgagaatatgctggga

SEQ ID NO: 7857 - DNA, 389 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaaaccgcgagttgtcccaaaaccaggagatgggcagaaaatatacgagattgacccaacgctgaaagatttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7858 - DNA, 418 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaattttggggaacatcaaagagacaaagactagggaccactatttcttacagttcccctcatggtctgagaatatgctgggga

SEQ ID NO: 7859 - DNA, 425 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcaaaggagttaaggaactagtcgtgggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7860 - DNA, 376 bp, Artificial; identical to SEQ ID NO: 7657
  TaSBEIIa allele with mutations introduced by TALEN pair TaSBEIIa_T02

SEQ ID NO: 7861 - DNA, 200 bp, Artificial; identical to SEQ ID NO: 7622
  TaSBEIIa allele with mutations introduced by TALEN pair TaSBEIIa_T02

SEQ ID NO: 7862 - DNA, 376 bp, Artificial; identical to SEQ ID NO: 7660
  TaSBEIIa allele with mutations introduced by TALEN pair TaSBEIIa_T02

SEQ ID NO: 7863 - DNA, 447 bp, Artificial; identical to SEQ ID NO: 7798
  TaSBEIIa allele with mutations introduced by TALEN pair TaSBEIIa_T02

SEQ ID NO: 7864 - DNA, 422 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttctacagttcccctcatggtctgagaatatgctggga

SEQ ID NO: 7865 - DNA, 418 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcgggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 7866 - DNA, 367 bp, Artificial; identical to SEQ ID NO: 7647
  TaSBEIIa allele with mutations introduced by TALEN pair TaSBEIIa_T02

SEQ ID NO: 7867 - DNA, 431 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcaccaaaggagttaaggaactagtcgtgggggagaaaccgcgagttgtcccaaaaaccaggagatgggcagaaaaatatacgagattgacccaacgctgaaaagattttcggagccatcttgactaccggtaatgcctacccgctactttcgctcattttgaattaaggtcctttcgtcatgcaaatttggggaacatcaaagagacaaagactagggaccactattcttacagttccctcatggtctgagaatatgctggga

SEQ ID NO: 7868 - DNA, 410 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaagttaaggaactagtcgcgggggagaaaccgcgagttgtcccaaaaccaggagatgggcagaaatatacgagattgacccaacgctgaaagattttcggagccatcttgactaccggtaatgcctacccgctaatttcgctcattttgaattaaggtcctttcatcatgcaaatttgggaacatcaaagaggcaaagactagggaccactatttcatacagttcccctcatggtctgagaatatgctggga

SEQ ID NO: 7869 - DNA, 429 bp, Artificial; identical to SEQ ID NO: 7686
  TaSBEIIa allele with mutations introduced by TALEN pair TaSBEIIa_T02

SEQ ID NO: 7870 - DNA, 458 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagatcccctcgtggtctgagaatatgctggga

SEQ ID NO: 7871 - DNA, 200 bp, Artificial; identical to SEQ ID NO: 7622
  TaSBEIIa allele with mutations introduced by TALEN pair TaSBEIIa_T02

SEQ ID NO: 7872 - DNA, 451 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgaaaatatgctgga

SEQ ID NO: 7873 - DNA, 461 bp, Artificial; identical to SEQ ID NO: 7735
  TaSBEIIa allele with mutations introduced by TALEN pair TaSBEIIa_T02

SEQ ID NO: 7874 - DNA, 419 bp, Artificial
  TaSBEIIa allele with mutations introduced by TALEN pair TaSBEIIa_T02
  misc_feature (396): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctnatggtctgaagaatatgctggga

SEQ ID NO: 7875 - DNA, 430 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggaactagtcgtgggggagaaaccgcgagttgtcccaaaaccaggagatgggcaagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7876 - DNA, 433 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttggatggtgtaaccaaaggagttaaggaactagtcgtgggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7877 - DNA, 383 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttgtcccaaaaccaggagatgggcagaaaatatacgagattgacccaacgctgaaagattttcggagccatcttgactaccggtaatgcctacccgctactttcgctcatttgaattaaggtcctttcgtcatgcaaatttggggaacatcaaagagacaaagactagggaccactatttcttacagttcccctcatggtctgagaatatgctggga

SEQ ID NO: 7878 - DNA, 367 bp, Artificial; identical to SEQ ID NO: 7647
  TaSBEIIa allele with mutations introduced by TALEN pair TaSBEIIa_T02

SEQ ID NO: 7879 - DNA, 342 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagaaaccgcgagttgtcccaaaaccaggagatgggcagaaaatatacgagattgacccaacgctgaaagattttcggagccatcttgactaccggtaatgcctaccgctactttcgctcattttgaattaaggtcctttcgtcatgcaaatttggggaacatcaaagagacaaagactagggaccactatttcttacagttccctcatggtctgagaatatgctggga

SEQ ID NO: 7880 - DNA, 445 bp, Artificial
  TaSBEIIa allele with mutations introduced by TALEN pair TaSBEIIa_T02
  misc_feature (217): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactggtgtaaccaaaggagttaaggaactagtcgtggggganaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattcttacagttcccctcatggtctgagaatatgctggga

SEQ ID NO: 7881 - DNA, 344 bp, Artificial; identical to SEQ ID NO: 7666
  TaSBEIIa allele with mutations introduced by TALEN pair TaSBEIIa_T02

SEQ ID NO: 7882 - DNA, 458 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcatacagatcccctcgtggtctgagaatatgctggga

SEQ ID NO: 7883 - DNA, 342 bp, Artificial
  TaSBEIIa allele with mutations introduced by TALEN pair TaSBEIIa_T02
  misc_feature (320): n is a or c or t or g
tcagatggatgtgcattctagcaagaacttcacgaaataatgcactgtttgtggtttcgttagtctgctctacaattgctattttcgtgctgtagatacaactagtcgtggggagaaaccgcgagttgtcccaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctnatggtctgagaatatgctggga

SEQ ID NO: 7884 - DNA, 375 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttgggaacatcaaagagacaaagactagggaccactatttcttacagttcccctcatggtctgagaatatgctggga

SEQ ID NO: 7885 - DNA, 406 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatctagtcgtgggggagaaaccgcgagttgtcccaaaaccaggagatgggcagaaaatatacgagattgacccaacgctgaaagattttcggagccatcttgactaccggtaatgcctaccgctactttcgctcattttgaattaaggtcctttcgtcatgcaaatttggggaacatcaaagagacaaagactagggaccactatttcttacagttcccctcatggtctgagaatatgctggga

SEQ ID NO: 7886 - DNA, 438 bp, Artificial
  TaSBEIIa allele with mutations introduced by TALEN pair TaSBEIIa_T02
  misc_feature (211): n is a or c or t or g
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcaaaggagttaaggaactagtcgtggggganaaaccgcgagttgtcccaaaaccaggagatgggcagaaaatatacgagattgacccaacactgaaagattttcggagccatcttgactaccggtaatgcctacccgctgctttcgctcattttgaattaaggtcctttcatcatgcaaatttggggaacatcaaagagacaaagactagggaccaccatttcatacagatccctcgtggtctgagaatatgctggga

SEQ ID NO: 7887 - DNA, 409 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcaaaggagttaaggaactagtcgtgggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctgga

SEQ ID NO: 7888 - DNA, 461 bp, Artificial; identical to SEQ ID NO: 7735
  TaSBEIIa allele with mutations introduced by TALEN pair TaSBEIIa_T02

SEQ ID NO: 7889 - DNA, 375 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactaagggaccactattctacagttccctcatggtctgagaatatcgctggga

SEQ ID NO: 7890 - DNA, 457 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtccttcgtcatgcaatttgggacatcaaagagacaaagactagggaccactatttcttacagttcccctcatggtctgagaatatgctggga

SEQ ID NO: 7891 - DNA, 374 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtgaactagtcgtgggggagaaaccgcgagttgtcccaaaaccaggagatgggcagaaaatatacgagattgacccaacgctgaaagattttcggagccatcttgactaccggtaatgcctacccgctactttcgctcatttgaattaaggtcctttcgtcatgcaaatttgggaacatcaaagagacaaagactagggaccactatttcttacagttcccctcatggtctgagaatatgctggga

SEQ ID NO: 7892 - DNA, 416 bp, Artificial
  TaSBEIIa allele with mutations introduced by TALEN pair TaSBEIIa_T02
  misc_feature (393): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgagttaaggaactagtcgtgggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttctacagttcccctnatggtctgagaatatgcgtggga

SEQ ID NO: 7893 - DNA, 440 bp, Artificial
  TaSBEIIa allele with mutations introduced by TALEN pair TaSBEIIa_T02
  misc_feature (211): n is a or c or t or g
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcaggagttaaggaactagtcgcggggganaaaccgcgagttgtcccaaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 7894 - DNA, 456 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattggtgtaaccaaaggagttaaggaactagtcgtgggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7895 - DNA, 383 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7896 - DNA, 344 bp, Artificial; identical to SEQ ID NO: 7653
  TaSBEIIa allele with mutations introduced by TALEN pair TaSBEIIa_T02

SEQ ID NO: 7897 - DNA, 449 bp, Artificial
  TaSBEIIa allele with mutations introduced by TALEN pair TaSBEIIa_T02
  misc_feature (246): n is a or c or t or g
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcaatcactgatggtgtaaccaaaggagttaaggaactagtcgcgggggagaaaccgcgagttgtcccaaaaaccnggagatgggcagaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 7898 - DNA, 350 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 7899 - DNA, 200 bp, Artificial; identical to SEQ ID NO: 7622
  TaSBEIIa allele with mutations introduced by TALEN pair TaSBEIIa_T02

SEQ ID NO: 7900 - DNA, 356 bp, Artificial; identical to SEQ ID NO: 7800
  TaSBEIIa allele with mutations introduced by TALEN pair TaSBEIIa_T02

SEQ ID NO: 7901 - DNA, 462 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggtggtgtaaccaaaggagttaaggaactagtcgcgggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttgggaacatcaaagaggcaaagactagggaccactatttcatacagttcccctcatggtctgagaatatgctggga

SEQ ID NO: 7902 - DNA, 402 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaattttggggaacatcaaagagacaaagactagggaccactatttcttacagttcccctcatggtctgagaatatgctggga

SEQ ID NO: 7903 - DNA, 422 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttccctcatggtctgagaatatgctggga

SEQ ID NO: 7904 - DNA, 456 bp, Artificial
  TaSBEIIa allele with mutations introduced by TALEN pair TaSBEIIa_T02
tcagatggatgtgcattctagcaagaacttcacgaaataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcgatggtgtaaccaaaggagttaaggaactagtcgtgggggagaaaccgcgagttgtcccaaaaaccaggagatgggcagaaaatatacgagattgacccaacactgaaagattttcggagccatcttgactaccggtaatgcctacccgctgctttcgctcattttgaattaaggtcctttcatcatgcaaatttggggaacatcaaagagacaaagactagggaccaccattccatacagatccctcgtggtctgagaatatgctggga

SEQ ID NO: 7905 - DNA, 453 bp, Artificial
  TaSBEIIa allele with mutations introduced by TALEN pair TaSBEIIa_T02
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcactgatggtgtaaccaaaggagttaaggaactagtcgtgggggagaaaccgcgagttgtcccaaaaccaggagatgggcagaaaatatacgagattgacccaacactgaaagattttcggagccatcttgactaccggtaatgcctaccgctgctttcgctcattttgaattaaggtcctttcatcatgcaaatttggggaacatcaaagagacaaagactagggaccaccatttcatacagatcccctcgtggtctgagaatatgctggga

SEQ ID NO: 7906 - DNA, 200 bp, Artificial; identical to SEQ ID NO: 7622
  TaSBEIIa allele with mutations introduced by TALEN pair TaSBEIIa_T02

SEQ ID NO: 7907 - DNA, 461 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcatttgaattaaggtccttcgtcatgcaaatttggggaacatcaaagagacaaagactagggaccactatttcttacagttcccctcatggtctgagaatatgctggga

SEQ ID NO: 7908 - DNA, 450 bp, Artificial; identical to SEQ ID NO: 7687
  TaSBEIIa allele with mutations introduced by TALEN pair TaSBEIIa_T02

SEQ ID NO: 7909 - DNA, 454 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgaacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattcttacagttccctcatggtctgagaatatgctggga

SEQ ID NO: 7910 - DNA, 415 bp, Artificial
  TaSBEIIa allele with mutations introduced by TALEN pair TaSBEIIa_T02
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccagtcgtgggggagaaaccgcgagttgtcccaaaaccaggagatgggcagaaaatatacgagattgacccaacactgaaagattttcggagccatcttgactaccggtaatgcctacccgctgctttcgctcattttgaattaaggtcctttcatcatgcaaatttggggaacatcaaagagacaaagactagggaccaccattcatacagatccctcgtggtctgagaatatgctggga

SEQ ID NO: 7911 - DNA, 451 bp, Artificial
  TaSBEIIa allele with mutations introduced by TALEN pair TaSBEIIa_T02
  misc_feature (225): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcactgatggtgtaaccaaaggagttaaggaactagtcgtggggganaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattctacagttcccctcatggtctgagaatatgctggga

SEQ ID NO: 7912 - DNA, 190 bp, Artificial; identical to SEQ ID NO: 7632
  TaSBEIIa allele with mutations introduced by TALEN pair TaSBEIIa_T02

SEQ ID NO: 7913 - DNA, 441 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcaaaggagttaaggaactagtcgcgggggagaaaccgcgagttgtcccaaaaaccaggagatgggcagaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 7914 - DNA, 448 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcataaccaaaggagttaaggaactagtcgtgggggagaaaccgcgagttgtcccaaaaaccaggagatgggcagaaaatatacgagattgacccaacgctgaaagatttcggagccatcttgactaccggtaatgcctacccgctactttcgctcattttgaattaaggtcctttcgtcatgcaaatttggggaacatcaaagagacaaagactagggaccactatttcttacagttccctcatggtctgagaatatgctggga

SEQ ID NO: 7915 - DNA, 344 bp, Artificial; identical to SEQ ID NO: 7653
  TaSBEIIa allele with mutations introduced by TALEN pair TaSBEIIa_T02

SEQ ID NO: 7916 - DNA, 200 bp, Artificial; identical to SEQ ID NO: 7622
  TaSBEIIa allele with mutations introduced by TALEN pair TaSBEIIa_T02

SEQ ID NO: 7917 - DNA, 439 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7918 - DNA, 457 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttctacagttcccctcatggtctgagaatatgctggga

SEQ ID NO: 7919 - DNA, 418 bp, Artificial
  TaSBEIIa allele with mutations introduced by TALEN pair TaSBEIIa_T02
  misc_feature (386): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcccttanagttcccctcatggtctgagaatatgctggga

SEQ ID NO: 7920 - DNA, 444 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcaccaaaggagttaaggaactagtcgtgggggagaaaccgcgagttgtcccaaaaccaggagatgggcagaaaatatacgagattgacccaacgctgaaagatttcggagccatcttgactaccggtaatgcctaccgctactttcgctcattttgaattaaggtcctttcgtcatgcaaatttggggaacatcaaagagacaaagactagggaccactatttcttacagttcccctcatggtctgagaatatgctggga

SEQ ID NO: 7921 - DNA, 345 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggttgaagtaaacatgacagggggactgcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7922 - DNA, 390 bp, Artificial; identical to SEQ ID NO: 7695
  TaSBEIIa allele with mutations introduced by TALEN pair TaSBEIIa_T02

SEQ ID NO: 7923 - DNA, 432 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttggatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7924 - DNA, 384 bp, Artificial; identical to SEQ ID NO: 7781
  TaSBEIIa allele with mutations introduced by TALEN pair TaSBEIIa_T02

SEQ ID NO: 7925 - DNA, 447 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggagttaaggaactagtcgtgggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaattttggggaacatcaaagagacaaagactagggaccactatttcttacagttcccctcatggtctgagaatatgctggga

SEQ ID NO: 7926 - DNA, 381 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7927 - DNA, 420 bp, Artificial; identical to SEQ ID NO: 7812
  TaSBEIIa allele with mutations introduced by TALEN pair TaSBEIIa_T02

SEQ ID NO: 7928 - DNA, 459 bp, Artificial
  TaSBEIIa allele with mutations introduced by TALEN pair TaSBEIIa_T02
  misc_feature (232): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggatcactgatggtgtaaccaaaggagttaaggaactagtcgtggggganaaaccgcgagttgtcccaaaaccaggagatgggcagaaaatatacgagattgacccaacgctgaaagattttcggagccatcttgactaccggtaatgcctacccgctactttcgctcattttgaattaaggtccttcgtcatgcaaatttggggaacatcaaagagacaaagactagggaccactatttcttacagttcccctcatggtctgagaatatgctggga

SEQ ID NO: 7929 - DNA, 405 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaactgaactagtcgtggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7930 - DNA, 454 bp, Artificial
  TaSBEIIa allele with mutations introduced by TALEN pair TaSBEIIa_T02
  misc_feature (229): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattatggtgtaaccaaaggagttaaggaactagtcgtggggganaaaccgcgagttgtcccaaaaccaggagatgggcagaaatatacgagattgacccaacgctgaaagattttcggagccatcttgactaccggtaatgcctacccgctactttcgctcattttgaattaaggtccttcgtcatgcaaatttggggaacatcaaagagacaaagactagggaccactatttctacagttcccctcatggtctgagaatatgctggga

SEQ ID NO: 7931 - DNA, 420 bp, Artificial; identical to SEQ ID NO: 7812
  TaSBEIIa allele with mutations introduced by TALEN pair TaSBEIIa_T02

SEQ ID NO: 7932 - DNA, 403 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaactgaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattcttacagttccctcatggtctgagaatatgctggga

SEQ ID NO: 7933 - DNA, 429 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttccctcatggtctgagaatatgctggga

SEQ ID NO: 7934 - DNA, 459 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattcttacagttcccctcatggtctgagaatatgctggga

SEQ ID NO: 7935 - DNA, 375 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7936 - DNA, 377 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaattttggggaacatcaaagagacaaagactagggaccactatttcttacagttcccctcatggtctgagaatatgctggga

SEQ ID NO: 7937 - DNA, 463 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcatttgaattaaggtcctttcgtcatgcaaatttggggaacatcaaagagacaaagactagggaccactatttcttacagttcccctcatggtctgagaatatgctggga

SEQ ID NO: 7938 - DNA, 383 bp, Artificial; identical to SEQ ID NO: 7895
  TaSBEIIa allele with mutations introduced by TALEN pair TaSBEIIa_T02

SEQ ID NO: 7939 - DNA, 367 bp, Artificial; identical to SEQ ID NO: 7647
  TaSBEIIa allele with mutations introduced by TALEN pair TaSBEIIa_T02

SEQ ID NO: 7940 - DNA, 463 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcaaacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtccttcgtcatgcaaatttggggaacatcaaagagacaaagactagggaccactattcttacagttcccctcatggtctgagatatgctggga

SEQ ID NO: 7941 - DNA, 455 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctaccgctactttcgctcattttgaattaaggtcctttcgtcatgcaaatttggggaacatcaaagagacaaagactagggaccactattcttacagttcccctcatggtctgagaatatgctggga

SEQ ID NO: 7942 - DNA, 316 bp, Artificial
  TaSBEIIa allele with mutations introduced by TALEN pair TaSBEIIa_T02
tcagatggatgtacattctagcaagaacttcacaacataatgcaccgtttggggtttcgtcagtctgctctacaattgctattttcgtgctgtagatagttgtcccaaaaccaggagatgggcagaaatatacgagattgacccaacactgaaagattttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 7943 - DNA, 462 bp, Artificial
  TaSBEIIa allele with mutations introduced by TALEN pair TaSBEIIa_T02
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcaatcactgatggtgtaaccaaaggagttaaggaactagtcgtgggggagaaaccgcgagttgtcccaaaaccaggagatgggcagaaaatatacgagattgacccaacactgaaagattttcggagccatcttgactaccggtaatgcctacccgctgctttcgctcattttgaattaaggtcctttcatcatgcaaatttgggaacatcaaagagacaaagactagggaccaccatttcatacagatcccctcgtggtctgagaatatgctggga

SEQ ID NO: 7944 - DNA, 388 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaacatgacaggggggactgcagaaaaacttgaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactaggaccactatttcttacagttcccctcatggtctgagaatatgctggga

SEQ ID NO: 7945 - DNA, 465 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaagggaacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7946 - DNA, 462 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttgggaacatcaaagagacaaagactagggaccactatttcttacagttcccctcatggtctgagaatatgctggga

SEQ ID NO: 7947 - DNA, 456 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctaccgctactttcgctcattttgaattaaggtcctttcgtcatgcaaatttggggaacatcaaagagacaaagactagggaccactatttcttacagttcccctcatggtctgagaatatgctggga

SEQ ID NO: 7948 - DNA, 448 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcataaccaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaattttggggaacatcaaagagacaaagactagggaccactatttcttacagttcccctcatggtctgagaatatgctgga

SEQ ID NO: 7949 - DNA, 401 bp, Artificial
  TaSBEIIa allele with mutations introduced by TALEN pair TaSBEIIa_T02
  misc_feature (197): n is a or c or t or g
tcagatggatgtgcattctagcaagaacttcacaaaataatgcactgtttgtggtttcgtttgtctgctctacgattgctattttcgtgtgctgtagatacctgaagatatcgaggagcaaacggctgaagtgaacatgacaggggggaccgcagagaaacttgaatcttcagaacccgcgagttgtcccaaaaccnggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 7950 - DNA, 203 bp, Artificial
  TaSBEIIa allele with mutations introduced by TALEN pair TaSBEIIa_T02
tcagatggatgtgcattctagcaagaacttcacgaaatgatttcggagcctatcttgactaccggtaatgcctacccgctactttcgcttcattttgaattaaggtcctttcgtcatgcaaatttggggaacatcaaagagacaaagactagggaccacgtatttcttacagttacccctcatggtctgagaatatgctggga

SEQ ID NO: 7951 - DNA, 453 bp, Artificial
  TaSBEIIa allele with mutations introduced by TALEN pair TaSBEIIa_T02
  misc_feature (226): n is a or c or t or g
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcactgatggtgtaaccaaaggagttaaggaactagtcgtggggganaaaccgcgagttgtcccaaaaacaggagatgggcagaaaatatacgagattgacccaacactgaaagattttcggagccatcttgactaccggtaatgcctaccgctgctttcgctcattttgaattaaggtcctttcatcatgcaaatttggggaacatcaaagagacaaagactagggaccaccatttcatacagatcccctcgtggtctgagaatatgctggga

SEQ ID NO: 7952 - DNA, 458 bp, Artificial; identical to SEQ ID NO: 7407
  TaSBEIIa allele with mutations introduced by TALEN pair TaSBEIIa_T02

SEQ ID NO: 7953 - DNA, 376 bp, Artificial
  TaSBEIIa allele with mutations introduced by TALEN pair TaSBEIIa_T02
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggagaaaccgcgagttgtcccaaaaccaggagatgggcagaaaatatacgagattgacccaacactgaaagattttcggagccatcttgactaccggtaatgcctacccgctgctttcgctcattttgaattaaggtctttcatcatgcaaatttggggaacatcaaagagacaaagactagggaccaccatttcatacagatcccctcgtggtctgagaatatgctggga

SEQ ID NO: 7954 - DNA, 450 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactgatggtgtaaccaaaggagttaaggaactagtcgtgggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7955 - DNA, 390 bp, Artificial; identical to SEQ ID NO: 7695
  TaSBEIIa allele with mutations introduced by TALEN pair TaSBEIIa_T02

SEQ ID NO: 7956 - DNA, 391 bp, Artificial
  TaSBEIIa allele with mutations introduced by TALEN pair TaSBEIIa_T02
  misc_feature (369): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttccccctnatggtctgagaatatgctggga

SEQ ID NO: 7957 - DNA, 200 bp, Artificial; identical to SEQ ID NO: 7622
  TaSBEIIa allele with mutations introduced by TALEN pair TaSBEIIa_T02

SEQ ID NO: 7958 - DNA, 384 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaaatttggggaacatcaaagagacaaagactagggaccactatttcttacagttcccctcatggtctgagaatatgctggga

SEQ ID NO: 7959 - DNA, 451 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcactgatggtgtaaccaaaggagttaaggaactagtcgtgggggagaaaccgcgagttgtcccaaaaccaggagatgggcagaaaatatacgagattgacccaacgctgaaagatttcggagccatcttgactaccggtaatgcctacccgctacttcgctcattttgaattaaggtcctttcgtcatgcaaatttggggaacatcaaagagacaaagactagggaccactatttcttacagttcccctcatggtctgagaatatgctggga

SEQ ID NO: 7960 - DNA, 376 bp, Artificial; identical to SEQ ID NO: 7657
  TaSBEIIa allele with mutations introduced by TALEN pair TaSBEIIa_T02

SEQ ID NO: 7961 - DNA, 455 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattcttacagttcccctcatggtctgagaatatgctggga

SEQ ID NO: 7962 - DNA, 449 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7963 - DNA, 454 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgattaaggtcctttcgtcatgcaatttggggaacatcaaagagacaaagactagggaccactatttcttacagttcccctcatggtctgagaatatgctggg

SEQ ID NO: 7964 - DNA, 458 bp, Artificial; identical to SEQ ID NO: 7407
  TaSBEIIa allele with mutations introduced by TALEN pair TaSBEIIa_T02

SEQ ID NO: 7965 - DNA, 344 bp, Artificial; identical to SEQ ID NO: 7666
  TaSBEIIa allele with mutations introduced by TALEN pair TaSBEIIa_T02

SEQ ID NO: 7966 - DNA, 326 bp, Artificial; identical to SEQ ID NO: 7855
  TaSBEIIa allele with mutations introduced by TALEN pair TaSBEIIa_T02

SEQ ID NO: 7967 - DNA, 456 bp, Artificial
  TaSBEIIa allele with mutations introduced by TALEN pair TaSBEIIa_T02
tcagatggatgtgcattactagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtgtaaccaaaggagttaaggaactagtcgtgggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7968 - DNA, 462 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaattttgggaacatcaaagagacaaagactagggaccactatttcttacagttcccctcatggtctgaaatatgctggga

SEQ ID NO: 7969 - DNA, 464 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaagggaacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttgggaacatcaaagagacaaagactagggaccactatttcttacagttcccctcatggtctgagaatatgctggga

SEQ ID NO: 7970 - DNA, 452 bp, Artificial; identical to SEQ ID NO: 7854
  TaSBEIIa allele with mutations introduced by TALEN pair TaSBEIIa_T02

SEQ ID NO: 7971 - DNA, 317 bp, Artificial
  TaSBEIIa allele with mutations introduced by TALEN pair TaSBEIIa_T02
tcagatggatgtacattctagcaagaacttcacacataatgcaccgtttggggtttcgtcagtctgctctacaattgctattttcgtgctgtagatagttgtcccaaaaccaggagatgggcagaaaatatacgagattgacccaacactgaaagattttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaaatatgctggga

SEQ ID NO: 7972 - DNA, 420 bp, Artificial; identical to SEQ ID NO: 7812
  TaSBEIIa allele with mutations introduced by TALEN pair TaSBEIIa_T02

SEQ ID NO: 7973 - DNA, 275 bp, Artificial
  TaSBEIIa allele with mutations introduced by TALEN pair TaSBEIIa_T02
tcagatggatgtgcattctagcaagaacttcacaaaataatgcactgttgtggtttcgtttgtctgctctacgagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 7974 - DNA, 424 bp, Artificial; identical to SEQ ID NO: 7847
  TaSBEIIa allele with mutations introduced by TALEN pair TaSBEIIa_T02

SEQ ID NO: 7975 - DNA, 384 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaattttggggaacatcaaagagacaaagactagggaccactatttcttacagttcccctcatggtctgagaatatgctggga

SEQ ID NO: 7976 - DNA, 422 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattggggggagaaaccgcgagttgtcccaaaaccaggagatgggcagaaaatatacgagattgacccaacgctgaaagatttcggagccatcttgactaccggtaatgcctacccgctacttcgctcattttgaattaaggtcctttcgtcatgcaaatttggggaacatcaaagagacaaagactagggaccactatttcttacagttcccctcatggtctgagaatatgctggga

SEQ ID NO: 7977 - DNA, 190 bp, Artificial; identical to SEQ ID NO: 7632
  TaSBEIIa allele with mutations introduced by TALEN pair TaSBEIIa_T02

SEQ ID NO: 7978 - DNA, 343 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacaactagtcgtgggggagaaaccgcgagttgtcccaaaaccaggagatgggcagaaaatatacgagattgacccaacgctgaaagattttcggagccatcttgactaccggtaatgcctacccgctactttcgctcatttgaattaaggtcctttcgtcatgcaaatttggggaacatcaaagagacaaagactagggaccactatttcttacagttcccctcatggtctgagaatatgctggga

SEQ ID NO: 7979 - DNA, 453 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctaccgctactttcgctcattttgaattaaggtcctttcgtcatgcaaatttggggaacatcaaagagacaaagactagggaccactatttcttacagttcccctcatggtctgagaatatgctggga

SEQ ID NO: 7980 - DNA, 435 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccaaaggagttaaggaactagtcgtgggggagaaaccgcgagttgtcccaaaaaccaggagatgggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7981 - DNA, 422 bp, Artificial
  TaSBEIIa allele with mutations introduced by TALEN pair TaSBEIIa_T02
  misc_feature (299): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactagtcgtgggggagaaaccgcgagttgtcccaaaaccaggagatgggcagaaaatatacgagattgacccaacgctgaaagattttcggagccatcttgactaccggtaatgcctacccgntactttcgctcattttgaattaaggtcctttcgtcatgcaaattttggggaacatcaaagagacaaagactagggaccactatttcttacagttcccctcatggtctgagaatatcgctggga

SEQ ID NO: 7982 - DNA, 464 bp, Artificial
  TaSBEIIa allele with mutations introduced by TALEN pair TaSBEIIa_T02
  misc_feature (236): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtcactgatggtgtaaccaaaggagttaaggaactagtcgtggggganaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7983 - DNA, 446 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcaccaaaggagttaaggaactagtcgtgggggagaaaccgcgagttgtcccaaaaccaggagatgggcagaaaatatacgagattgacccaacgctgaaagatttcggagccatcttgactaccggtaatgcctacccgctactttcgctcattttgaattaaggtcctttcgtcatgcaaatttggggaacatcaaaagagacaaagactagggaccactatttcttacagttcccctcatggtctgagaatatgctggga

SEQ ID NO: 7984 - DNA, 441 bp, Artificial
  TaSBEIIa allele with mutations introduced by TALEN pair TaSBEIIa_T02
  misc_feature (153); (213): n is a or c or t or g
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccncagagaaacttgaatcttcagaaccgactcaaaggagttaaggaactagtcgcggggganaaaccgcgagttgtcccaaaaaccaggagatgggcagaaaatatacgagattgacccaacgctgaaagatttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 7985 - DNA, 466 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgcaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattcttacagttcccctcatggtctgagaatatgctggga

SEQ ID NO: 7986 - DNA, 459 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcactggtctgagaatatgctggga

SEQ ID NO: 7987 - DNA, 452 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctacttcgctcattttgaattaaggtcctttcgtcatgcaaatttgggaacatcaaagagacaaagactagggacactattcttacagttccctcatgtctgagaatatgctggga

SEQ ID NO: 7988 - DNA, 459 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaatttaaggtcctttcgtcatgcaaatttggggaacatcaaagagacaaagactagggaccactatttcttacagttcccctcatggtctgagaatatgctggga

SEQ ID NO: 7989 - DNA, 467 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcaggaaacaatcactgatggtgtaaccaaaggagttaaggaactagtcgcgggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggacaaagactagggaccactattcatacagttcccctcatggtctgagaatatgctggga

SEQ ID NO: 7990 - DNA, 390 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaaaccgcgagttgtcccaaaaccaggagatgggcagaaaatatacgagattgacccaacgctgaaagattttcggagccatcttgactaccggtaatgcctacccgctactttcgctcattttgaattaaaggtcctttcgtcatgcaaatttggggaacatcaaaagagacaaagactaggaccactattcttacagttcccctcatggtctgagaatatgctggga

SEQ ID NO: 7991 - DNA, 375 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtccttcgtcatgcaaatttggggaacatcaaagagacaaagactagggaccactatttcttacagttcccctcatggtctgagaatatgctggga

SEQ ID NO: 7992 - DNA, 200 bp, Artificial; identical to SEQ ID NO: 7622
  TaSBEIIa allele with mutations introduced by TALEN pair TaSBEIIa_T02

SEQ ID NO: 7993 - DNA, 386 bp, Artificial
  TaSBEIIa allele with mutations introduced by TALEN pair TaSBEIIa_T02
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcaggagatgggcagaaaatatacgagattgacccaacactgaaagattttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 7994 - DNA, 445 bp, Artificial
  TaSBEIIa allele with mutations introduced by TALEN pair TaSBEIIa_T02
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatctaatcactgatggtgtaaccaaaggagttaaggaactagtcgtgggggagaaaccgcgagttgtcccaaaaccaggagatgggcagaaaatatacgagattgacccaacactgaaagattttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 7995 - DNA, 384 bp, Artificial; identical to SEQ ID NO: 7781
  TaSBEIIa allele with mutations introduced by TALEN pair TaSBEIIa_T02

SEQ ID NO: 7996 - DNA, 401 bp, Artificial; identical to SEQ ID NO: 7820
  TaSBEIIa allele with mutations introduced by TALEN pair TaSBEIIa_T02

SEQ ID NO: 7997 - DNA, 453 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgatcactgatggtgtaaccaaaggagttaaggaactagtcgtgggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7998 - DNA, 444 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagatatgctggga

SEQ ID NO: 7999 - DNA, 375 bp, Artificial; identical to SEQ ID NO: 7884
  TaSBEIIa allele with mutations introduced by TALEN pair TaSBEIIa_T02

SEQ ID NO: 8000 - DNA, 463 bp, Artificial
  TaSBEIIa allele with mutations introduced by TALEN pair TaSBEIIa_T02
  misc_feature (234): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcaatcactgatggtgtaaccaaaggagttaaggaactagtcgtggggganaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8001 - DNA, 384 bp, Artificial; identical to SEQ ID NO: 7781
  TaSBEIIa allele with mutations introduced by TALEN pair TaSBEIIa_T02

SEQ ID NO: 8002 - DNA, 441 bp, Artificial
  TaSBEIIa allele with mutations introduced by TALEN pair TaSBEIIa_T02
  misc_feature (213): n is a or c or t or g
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcaaaggagttaaggaactagtcgcggggganaaaccgcgagttgtcccaaaaaccaggagatgggcagaaaatatacgagattgacccaacgctgaaagattttcggagccatcttgactaccggtaatgcctacccgctaatttcgctcattttgaattaaggtcctttcatcatgcaaatttgggaacatcaaagaggcaaagactagggaccactatttcatacagttcccctcatggtctgagaatatgctggga

SEQ ID NO: 8003 - DNA, 200 bp, Artificial; identical to SEQ ID NO: 7622
  TaSBEIIa allele with mutations introduced by TALEN pair TaSBEIIa_T02

SEQ ID NO: 8004 - DNA, 456 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgaacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8005 - DNA, 445 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcaatcactgatggtgtaaccaaaggagttaaggaactagtcgtgggggagaaaccgcgagttgtcccaaaaccaggagatgggcagaaatatacgagattgacccaacgctgaaagattttcggagccatcttgactaccggtaatgcctacccgctactttcgctcattttgaattaaggtccttttcgtcatgctaaatttggggaaacatcaaagagacaaagactagggaccactatttcttacagttcccctcatggtctgagaatatgctggga

SEQ ID NO: 8006 - DNA, 467 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgcaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8007 - DNA, 436 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattctacagttcccctcatggtctgagaatatgctggga

SEQ ID NO: 8008 - DNA, 422 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaagtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8009 - DNA, 450 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcaatcactgatggtgtaaccaaaggagttaaggaactagtcgcgggggagaaaccgcgagttgtcccaaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 8010 - DNA, 444 bp, Artificial
  TaSBEIIa allele with mutations introduced by TALEN pair TaSBEIIa_T02
  misc_feature (217): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactggtgtaaccaaaggagttaaggactagtcgtggggganaaaccgcgagttgtcccaaaaccaggagatgggcagaaaatatacgagattgacccaacgctgaaagattttcggagccatcttgactaccggtaatgcctaccgctactttcgctcattttgaattaaggtcctttcgtcatgcaaatttggggaacatctaaagagacaaagactagggaccactattcttacagttcccctcatggtctgagaatatgctggga

SEQ ID NO: 8011 - DNA, 453 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcactgatggtgtaaccaaaggagttaaggaactagtcgtgggggagaaaccgcgagttgtcccaaaaaccaggagatgggcagaaaatatacgagattgacccaacgctgaaagattttcggagccatcttgactaccggtaatgcctacccgctacttcgctcattttgaattaaggtcctttcgtcatgcaaatttgggaacatcaaagagacaaagactaggggaccactatttcttacagttcccctcatggtctgagaatatgctggga

SEQ ID NO: 8012 - DNA, 445 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcaccaaaggagttaaggaactagtcgtgggggagaaaccgcgagttgtcccaaaaccaggagatgggcagaaaatatacgagattgacccaacgctgaaagatttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8013 - DNA, 375 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaagagacaaagactagggaccactatttcttacagttcccctcatggtctgagaatatgctggga

SEQ ID NO: 8014 - DNA, 460 bp, Artificial; identical to SEQ ID NO: 7770
  TaSBEIIa allele with mutations introduced by TALEN pair TaSBEIIa_T02

SEQ ID NO: 8015 - DNA, 460 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgcaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctaccgctacttcgctcatttgaattaaggtccttcgtcatgcaaatttgggaacatcaaagagacaaagactagggaccactattcttacagttccctcatggtctgagaatatgctggga

SEQ ID NO: 8016 - DNA, 408 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaattagtcgtgggggagaaaccgcgagttgtcccaaaaccaggagatgggcagaaaaatatacgagattgacccaacgctgaaagattttcggagccatcttgactaccggtaatgcctacccgctactttcgctcattttgaattaaggtcctttcgtcatgcaaattttggggaacatcaaagagacaaagactagggaccactatttcttacagttcccctcatggtctgagaatatgctggga

SEQ ID NO: 8017 - DNA, 451 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcactgatggtgtaaccaaaggagttaaggaactagtcgtgggggagaaaccgcgagttgtcccaaaaccaggagatgggcagaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattcttacagttcccctcatggtctgagaatatgctggga

SEQ ID NO: 8018 - DNA, 389 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaaaccgcgagttgtcccaaaaccaggagatgggcagaaaatatacgagattgacccaacgctgaaagattttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 8019 - DNA, 385 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttgtcccaaaaccaggagatgggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8020 - DNA, 458 bp, Artificial
  TaSBEIIa allele with mutations introduced by TALEN pair TaSBEIIa_T02
tcagatggatggcattctaggcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8021 - DNA, 375 bp, Artificial
  TaSBEIIa allele with mutations introduced by TALEN pair TaSBEIIa_T02
  misc_feature (353): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactaaccgcgagttgtcccaaaaccaggagatgggcagaaaatatacgagattgacccaacgctgaaagattttcggagccatcttgactaccggtaatgcctacccgctactttcgctcattttgattaaggtcctttcgtcatgcaaatttggggaacatcaaagagacaaagactagggaccactatttcttacagttcccctnatggtctgagaatatgctggga

SEQ ID NO: 8022 - DNA, 459 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8023 - DNA, 402 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 8024 - DNA, 454 bp, Artificial
  TaSBEIIa allele with mutations introduced by TALEN pair TaSBEIIa_T02
tcagatggatgtgcattctagcaagaacttcacgaaataatgcactgttcgtggtttcgttagtctgctctacaattgctattttcgtgctgtagatacctgaagacatcgaggagcaaacggctgaagtaaacatgacaggggggactgcagaaaaacttgaatcttcagaaccgactcactgatggtgtaaccaaaggagttaaggaactagtcgtgggggagaaaccgcgagttgtcccaaaaaccaggagatgggcagaaaatatacgagattgacccaacgctagaaagattttcggagccatcttgactaccggtaatgcctaccgctactttcgctcattttgaattaaggtcctttcgtcatgcaaatttggggaacatcaaagagacaaagactagggaccactatttcttacagttcccctcatggtctgagaatatgctggga

SEQ ID NO: 8025 - DNA, 406 bp, Artificial
  TaSBEIIa allele with mutations introduced by TALEN pair TaSBEIIa_T02
  misc_feature (222): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttggaactagtcgtgggggagaaaccgcgagttgtcccaaaaccaggagatgggcagaaaatntacgagattgacccaagctgaaagattttcggagccatcttgactaccggtaatgcctacccgctactttcgctcattttgaattaaggtcctttcgtcatgcaaatttggggaacatcaaagagacaaagactagggaccactattcttacagttcccctcatggtctgagaatatgctggga

SEQ ID NO: 8026 - DNA, 446 bp, Artificial
  TaSBEIIa allele with mutations introduced by TALEN pair TaSBEIIa_T02
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatctaatcactgatggtgtaaccaaaggagttaaggaactagtcgtgggggagaaaccgcgagttgtcccaaaaaccaggagatgggcagaaaatatacgagattgacccaacactgaaagattttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 8027 - DNA, 465 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcatcactgatggtgtaaccaaaggagttaaggaactagtcgcgggggagaaaccgcgagttgtcccaaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 8028 - DNA, 454 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaagtttggggaacatcaaagagacaaagactagggaccactatttcttacagttcccctcatggtctgagaatatgctggga

SEQ ID NO: 8029 - DNA, 200 bp, Artificial; identical to SEQ ID NO: 7622
  TaSBEIIa allele with mutations introduced by TALEN pair TaSBEIIa_T02

SEQ ID NO: 8030 - DNA, 276 bp, Artificial; identical to SEQ ID NO: 7823
  TaSBEIIa allele with mutations introduced by TALEN pair TaSBEIIa_T02

SEQ ID NO: 8031 - DNA, 465 bp, Artificial
  TaSBEIIa allele with mutations introduced by TALEN pair TaSBEIIa_T02
  misc_feature (239): n is a or c or t or g
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcaggaaacaatcactgatggtgtaaccaaaggagttaaggaactagtcgcggggganaaaccgcgagttgtcccaaaaccaggagatgggcagaaaatatacgagattgacccaacactgaaagattttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgggga

SEQ ID NO: 8032 - DNA, 382 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaccgcgagttgtcccaaaaccaggagatgggcagaaaatatacgagattgacccaacgctgaaagattttcggagccatcttgactaccggtaatgcctacccgctactttcgcttcattttgaattaaggtcctttcgtcatgcaaatttggggaacatcaaagagacaaaagactagggaccactattcttacagttcccctcatggtctgagaatatgctggga

SEQ ID NO: 8033 - DNA, 366 bp, Artificial; identical to SEQ ID NO: 7741
  TaSBEIIa allele with mutations introduced by TALEN pair TaSBEIIa_T02

SEQ ID NO: 8034 - DNA, 407 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattctacagttcccctcatggtctgagaatatgctggga

SEQ ID NO: 8035 - DNA, 455 bp, Artificial; identical to SEQ ID NO: 7836
  TaSBEIIa allele with mutations introduced by TALEN pair TaSBEIIa_T02

SEQ ID NO: 8036 - DNA, 421 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactagtcgtgggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8037 - DNA, 376 bp, Artificial; identical to SEQ ID NO: 7657
  TaSBEIIa allele with mutations introduced by TALEN pair TaSBEIIa_T02

SEQ ID NO: 8038 - DNA, 200 bp, Artificial; identical to SEQ ID NO: 7622
  TaSBEIIa allele with mutations introduced by TALEN pair TaSBEIIa_T02

SEQ ID NO: 8039 - DNA, 458 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8040 - DNA, 344 bp, Artificial; identical to SEQ ID NO: 7653
  TaSBEIIa allele with mutations introduced by TALEN pair TaSBEIIa_T02

SEQ ID NO: 8041 - DNA, 457 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcactgatggtgtaaccaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8042 - DNA, 451 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcactgatggtgtaaccaaaggagttaaggaactagtcgtgggggagaaaccgcgagttgtcccaaaaaccaggagatgggcagaaaatatacgagattgacccaacgctgaaagatttcggagccatcttgactaccggtaatgcctaccgctactttcgctcattttgaattaaggtcctttcgtcatgcaaatttggggaacatcaaagagacaaagactagggaccactattcttacagttcccctcatggtctgagaatatgctggga

SEQ ID NO: 8043 - DNA, 200 bp, Artificial; identical to SEQ ID NO: 7622
  TaSBEIIa allele with mutations introduced by TALEN pair TaSBEIIa_T02

SEQ ID NO: 8044 - DNA, 468 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgcaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcacttttgaattaaggtcctttcgtcatgcaaatttggggaacatcaaagagacaaagactagggaccactatttcttacagttcccctcatggtctgagaatatgctggga

SEQ ID NO: 8045 - DNA, 457 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttgggaacatcaaagagacaagactagggaccactattctacagttccctcatggtctgagaatatgctggga

SEQ ID NO: 8046 - DNA, 466 bp, Artificial; identical to SEQ ID NO: 7285
  TaSBEIIa allele with mutations introduced by TALEN pair TaSBEIIa_T02

SEQ ID NO: 8047 - DNA, 459 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagtaatatgctggga

SEQ ID NO: 8048 - DNA, 385 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaaatttggggaacatcaaagagacaaagactagggaccactatttcttacagttcccctcatggtctgagaatatgctggga

SEQ ID NO: 8049 - DNA, 200 bp, Artificial; identical to SEQ ID NO: 7622
  TaSBEIIa allele with mutations introduced by TALEN pair TaSBEIIa_T02

SEQ ID NO: 8050 - DNA, 343 bp, Artificial; identical to SEQ ID NO: 7978
  TaSBEIIa allele with mutations introduced by TALEN pair TaSBEIIa_T02

SEQ ID NO: 8051 - DNA, 200 bp, Artificial; identical to SEQ ID NO: 7622
  TaSBEIIa allele with mutations introduced by TALEN pair TaSBEIIa_T02

SEQ ID NO: 8052 - DNA, 375 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggagaaaccgcgagttgtcccaaaaccaggagatgggcagaaaaatatacgagattgacccaacgctgaaagattttcggagccatcttgactaccggtaatgcctacccgctactttcgctcattttgaattaaggtcctttcgtcatgcaaatttgggaacatcaaagagacaaagactaggaccactatttcttacagttcccctcatggtctgagaatatgctggga

SEQ ID NO: 8053 - DNA, 389 bp, Artificial; identical to SEQ ID NO: 7681
  TaSBEIIa allele with mutations introduced by TALEN pair TaSBEIIa_T02

SEQ ID NO: 8054 - DNA, 450 bp, Artificial; identical to SEQ ID NO: 7954
  TaSBEIIa allele with mutations introduced by TALEN pair TaSBEIIa_T02

SEQ ID NO: 8055 - DNA, 456 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcactgatggtgtaaccaaggagttaaggaactagtcgtgggggagaaaccgcgagttgtcccaaaaccaggagatgggcagaaaatatacgagattgacccaacgctgaaagattttcggagccatcttgactaccggtaatgccctaccgctactttcgctcattttgaattaaggtcctttcgtcatgcaaatttgggaacatcaaagagacaaagactagggaccactatttcttacagttcccctcatggtctgagaatatgctggga

SEQ ID NO: 8056 - DNA, 450 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctaatttcgtgctgtagatacctgaagacatcgaggagcaaacggctgaagtaaacatgacaggggggactgcagaaaaacttgaatcttcagaaccgactcaaggcataaccaaaggagttaaggaactagtcgtgggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8057 - DNA, 392 bp, Artificial; identical to SEQ ID NO: 7703
  TaSBEIIa allele with mutations introduced by TALEN pair TaSBEIIa_T02

SEQ ID NO: 8058 - DNA, 442 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcactgatggtgtaaccaaaggagttaaggaactagtcgtgggggagaaaccgcgagttgtacccaaaaaccaggagatgggcaagaaaaatatacgagattgacccaacgctgaaagattttcggagccatcttgactaccggtaatgcctacccgctacttcgctcattttgaattaaggtcctttcgtcatgcaaatttggggaacatcaaagagacaaagactagggaccactatttcttacagttcccctcatggtctgagaatatgctggga

SEQ ID NO: 8059 - DNA, 416 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactagtcgtgggggagaaaccgcgagttgtcccaaaaccaggagatgggcagaaaatatacgagattgacccaacgctgaaagatttcggagccatcttgactaccggtaatgcctacccgctactttcgctcattttgaattaaggtcctttcgtcatgcaaatttgggaacatcaaagagacaaagactagggaccactattcttacagttcccctcatggtctgagaatatgctggg

SEQ ID NO: 8060 - DNA, 423 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaagtgtaaccaaaggagttaaggaactagtcgtgggggagaaaccgcgagttgtcccaaaaccaggagatgggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8061 - DNA, 460 bp, Artificial
  TaSBEIIa allele with mutations introduced by TALEN pair TaSBEIIa_T02
  misc_feature (232): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcacaatcactgatggtgtaaccaaaggagttaaggaactagtcgtgggggganaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8062 - DNA, 457 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattcttacagttcccctcatggtctgagaatatgctggga

SEQ ID NO: 8063 - DNA, 457 bp, Artificial; identical to SEQ ID NO: 7788
  TaSBEIIa allele with mutations introduced by TALEN pair TaSBEIIa_T02

SEQ ID NO: 8064 - DNA, 462 bp, Artificial; identical to SEQ ID NO: 7766
  TaSBEIIa allele with mutations introduced by TALEN pair TaSBEIIa_T02

SEQ ID NO: 8065 - DNA, 452 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcatacagatcccctcgtggtctgagaatatgctgggactggactgccaaggcacacaggggatagg

SEQ ID NO: 8066 - DNA, 452 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtgtaaccaaaggagttaaggaactagtcgtgggggagaaaccgcgagttgtcccaaaaccaggagatgggcagaaaatatacgagattgaccaacgctgaaagatttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8067 - DNA, 459 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcactgatggtgtaaccaaaggagttaaggaactagtcgtgggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8068 - DNA, 346 bp, Artificial; identical to SEQ ID NO: 7742
  TaSBEIIa allele with mutations introduced by TALEN pair TaSBEIIa_T02

SEQ ID NO: 8069 - DNA, 375 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtgaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttgggaacatcaaagagacaaagactagggaccactatttcttacagttcccctcatggtctgagaatatgctggga

SEQ ID NO: 8070 - DNA, 440 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcaggagttaaggaactagtcgcgggggagaaaccgcgagttgtcccaaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 8071 - DNA, 456 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctaccgctactttcgctcattttgaattaaggtcctttcgtcatgcaaatttggggaacatcaaagagacaaagactagggaccactattcttacagttcccctcatggtctgagaatatgctggga

SEQ ID NO: 8072 - DNA, 430 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttggatggtgtaaccaaaggagttaaggaactagtcgtgggggagaaaccgcgagttgtcccaaaaccaggagatgggcagaaaatatacgagattgacccaacgctgaaagatttcggagccatcttgactaccggtaatgcctaccgctactttcgctcattttgaattaaggtcctttcgtcatgcaaatttggggaacatcaaagagacaaagactagggaccactatttcttacagttcccctcatggtctgagaatatgctggga

SEQ ID NO: 8073 - DNA, 452 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctaccgctactttcgctcattttgaattaaggtcctttcgtcatgcaaattttggggaacatcaaagagacaaagactagggaccactattcttacagttcccctcatggtctgagaatatgctggga

SEQ ID NO: 8074 - DNA, 404 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaactagtcgcgggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 8075 - DNA, 453 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattggtgtaaccaaaggagttaaggaactagtcgtgggggagaaaccgcgagttgtcccaaaaccaggagatgggcagaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatgtctgagaatatgctggga

SEQ ID NO: 8076 - DNA, 392 bp, Artificial; identical to SEQ ID NO: 7703
  TaSBEIIa allele with mutations introduced by TALEN pair TaSBEIIa_T02

SEQ ID NO: 8077 - DNA, 384 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttgtcccaaaaccaggagatgggcagaaaatatacgagattgacccaacgctgaaagatttcggagccatcttgactaccggtaatgcctacccgctactttcgctcattttgaattaaggtcctttcgtcatgcaaaatttggggaacatcaaagagacaaagactagggaccactatttcttacagttcccctcatggtctgagaatatgctggga

SEQ ID NO: 8078 - DNA, 421 bp, Artificial; identical to SEQ ID NO: 8036
  TaSBEIIa allele with mutations introduced by TALEN pair TaSBEIIa_T02

SEQ ID NO: 8079 - DNA, 387 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaaaccgcgagttgtcccaaaaccaggagatgggcagaaaatatacgagattgacccaacgctgaaagatttcggagccatcttgactaccggtaatgcctacccgctactttcgctcattttgaattaaggtcctttcgtcatgcaaatttggggaacatcaaagagacaaagactagggaccactattcttacagttcccctcatggtctgagaatatgctggga

SEQ ID NO: 8080 - DNA, 454 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgatcactgatggtgtaaccaaaggagttaaggaactagtcgtgggggagaaaccgcgagttgtcccaaaaaccaggagatggacagaaaatatacgagattgacccaacgctgaaagattttcggagccatcttgactaccggtaatgcctacccgctactttcgctcattttgaattaaggtcctttcgtcatgcaaattttggggaacatcaaagagacaaagactagggaccactatttcttacagttcccctcatggtctgagaatatgctggga

SEQ ID NO: 8081 - DNA, 344 bp, Artificial; identical to SEQ ID NO: 7666
  TaSBEIIa allele with mutations introduced by TALEN pair TaSBEIIa_T02

SEQ ID NO: 8082 - DNA, 461 bp, Artificial; identical to SEQ ID NO: 7735
  TaSBEIIa allele with mutations introduced by TALEN pair TaSBEIIa_T02

SEQ ID NO: 8083 - DNA, 353 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaattgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttccctcatggtctgagaatatgctggga

SEQ ID NO: 8084 - DNA, 430 bp, Artificial
  TaSBEIIa allele with mutations introduced by TALEN pair TaSBEIIa_T02
  misc_feature (226): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattggtcgtgggggagaaaccgcgagttgtcccaaaaaccnggagatgggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttccctcatggtctgagaatatgctggga

SEQ ID NO: 8085 - DNA, 460 bp, Artificial; identical to SEQ ID NO: 7269
  TaSBEIIa allele with mutations introduced by TALEN pair TaSBEIIa_T02

SEQ ID NO: 8086 - DNA, 449 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcataaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaaacatcaaagagacaaagactagggaccactattcttacagttcccctcatggtctgagaatatgctggga

SEQ ID NO: 8087 - DNA, 381 bp, Artificial; identical to SEQ ID NO: 7926
  TaSBEIIa allele with mutations introduced by TALEN pair TaSBEIIa_T02

SEQ ID NO: 8088 - DNA, 460 bp, Artificial; identical to SEQ ID NO: 7770
  TaSBEIIa allele with mutations introduced by TALEN pair TaSBEIIa_T02

SEQ ID NO: 8089 - DNA, 413 bp, Artificial
  TaSBEIIa allele with mutations introduced by TALEN pair TaSBEIIa_T02
  misc_feature (391): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttaaggaactagtcgtggggagaaaccgcgagttgtcccaaaaccaggagatgggcagaaaatatacgagattgacccaagctgaaagattttcggagccatcttgactaccggtaatgcctacccgctactttcgctcattttgaattaaggtcctttcgtcatgcaaatttgggaacatcaaagagacaaagactagggaccactattcttacagttcccctnatggtctgagaatatgctggga

SEQ ID NO: 8090 - DNA, 462 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcacaatcactgatggtgtaaccaaaggagttaaggaactagtcgcgggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 8091 - DNA, 383 bp, Artificial; identical to SEQ ID NO: 7895
  TaSBEIIa allele with mutations introduced by TALEN pair TaSBEIIa_T02

SEQ ID NO: 8092 - DNA, 367 bp, Artificial; identical to SEQ ID NO: 7647
  TaSBEIIa allele with mutations introduced by TALEN pair TaSBEIIa_T02

SEQ ID NO: 8093 - DNA, 342 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaatatacgagattgacccaacgctgaaagattttcggagccatcttgactaccggtaatgcctaccgctactttcgctcattttgaattaaggtcctttcgtcatgcaaatttggggaacatcaaagagacaaagactaggaccactattcttacagttccctcatggtctgagaatatgctggga

SEQ ID NO: 8094 - DNA, 343 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactaggaccactatttcttacacgttccctcatggtctgagaatatgctggga

SEQ ID NO: 8095 - DNA, 452 bp, Artificial; identical to SEQ ID NO: 8073
  TaSBEIIa allele with mutations introduced by TALEN pair TaSBEIIa_T02

SEQ ID NO: 8096 - DNA, 437 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacaatcactgatggtgtaaccaaaggagttaaggaactagtcgtgggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8097 - DNA, 407 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattcttacagttccctcatggtctgagaatatgctggga

SEQ ID NO: 8098 - DNA, 318 bp, Artificial
  TaSBEIIa allele with mutations introduced by TALEN pair TaSBEIIa_T02
tcagatggatgtgcattctagcaagaacttcacaacataatgcaccgtttggggtttcgtcagtctgctctacaattgctatttttcgtgctgtagatagttgtcccaaaaccaggagatgggcagaaaatatacgagattgacccaacactgaaagattttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 8099 - DNA, 447 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcataaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattcttacagttccctcatggtctgagaatatgctggga

SEQ ID NO: 8100 - DNA, 276 bp, Artificial; identical to SEQ ID NO: 7823
  TaSBEIIa allele with mutations introduced by TALEN pair TaSBEIIa_T02

SEQ ID NO: 8101 - DNA, 375 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtgaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttccctcatggtctgagaatatgctggga

SEQ ID NO: 8102 - DNA, 367 bp, Artificial; identical to SEQ ID NO: 7647
  TaSBEIIa allele with mutations introduced by TALEN pair TaSBEIIa_T02

SEQ ID NO: 8103 - DNA, 417 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaaaccaaaggagttaaggaactagtcgtgggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaatttgggaacatcaaagagacaaagactaggaccactattcttacagttcccctcatggtctgagaatatgctggga

SEQ ID NO: 8104 - DNA, 457 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttgggaacatcaaagagacaaagactagggaccactatttcttacagttcccctcatggtctgagaatatgctggga

SEQ ID NO: 8105 - DNA, 200 bp, Artificial; identical to SEQ ID NO: 7622
  TaSBEIIa allele with mutations introduced by TALEN pair TaSBEIIa_T02

SEQ ID NO: 8106 - DNA, 403 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaattttggggaacatcaaagaggcaaagactagggaccactatttcatacagttcccctcatggtctgagaatatgctggga

SEQ ID NO: 8107 - DNA, 203 bp, Artificial
  TaSBEIIa allele with mutations introduced by TALEN pair TaSBEIIa_T02
tcagatggatgtgcattctagcaagaacttcacgaaatgattttcggagccatcttgactaccggtaatgcctacccgctactttcgcttcattttgaattaaggtcctttcgtcatgcaaatttggggaacatcaaagagacaaagactagggaccacgtatttcttacagttacccctcatggtctgagaatatgctggga

SEQ ID NO: 8108 - DNA, 459 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctacttcgctcattttgaattaaggtcctttcgtcatgcaaatttgggaacatcaaagagacaaagactagggaccactattcttacagttcccctcatggtctgagaatatgctggga

SEQ ID NO: 8109 - DNA, 200 bp, Artificial; identical to SEQ ID NO: 7622
  TaSBEIIa allele with mutations introduced by TALEN pair TaSBEIIa_T02

SEQ ID NO: 8110 - DNA, 434 bp, Artificial
  TaSBEIIa allele with mutations introduced by TALEN pair TaSBEIIa_T02
tcagatggatgtgacattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttggatggtgtaaccaaaggagttaaggaactagtcgtgggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8111 - DNA, 460 bp, Artificial
  TaSBEIIa allele with mutations introduced by TALEN pair TaSBEIIa_T02
  misc_feature (457): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcaatcactgatggtgtaaccaaaggagttaaggaactagtcgtgggggagaaaccgcgagttgtcccaaaaaccaggagatgggcagaaaatatacgagattgacccaacgctgaaagattttcggagccatcttgactaccggtaatgcctacccgctactttcgctcattttgaattaaggtccttcgtcatgcaaatttggggaacatcaaagagacaaagactagggaccactatttcttacagttcccctcatggtctgagatatgcnggg

SEQ ID NO: 8112 - DNA, 467 bp, Artificial; identical to SEQ ID NO: 8006
  TaSBEIIa allele with mutations introduced by TALEN pair TaSBEIIa_T02

SEQ ID NO: 8113 - DNA, 452 bp, Artificial
  TaSBEIIa allele with mutations introduced by TALEN pair TaSBEIIa_T02
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcactgatggtgtaaccaaaggagttaaggaactagtcgtggggagaaaccgcgagttgtcccaaaccaggagatgggcagaaaatatacgagattgacccaacactgaaagattttcggagccatcttgactaccggtaatgcctacccgctgctttcgctcattttgaattaaggtcctttcatcatgcaaatttggggaacatcaaagagacaaagactaggggacaccatttcatacagatcccctcgtggtctgagaatatgctggga

SEQ ID NO: 8114 - DNA, 453 bp, Artificial; identical to SEQ ID NO: 7777
  TaSBEIIa allele with mutations introduced by TALEN pair TaSBEIIa_T02

SEQ ID NO: 8115 - DNA, 407 bp, Artificial
  TaSBEIIa allele with mutations introduced by TALEN pair TaSBEIIa_T02
  misc_feature (221): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaattagtcgtgggggagaaaccgcgagttgtcccaaaaccaggagatgggcagaaaatntacgagattgacccaagctgaaagattttcggagccatcttgactaccggtaatgcctacccgctactttcgctcattttgaattaaggtcctttcgtcatgcaaattttggggaacatcaaagagacaaagactagggaccactatttcttacagttcccctcatggtctgagaatatgctggga

SEQ ID NO: 8116 - DNA, 412 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaagttaaggaactagtcgtgggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaattttggggaacatcaaagagacaaagactagggaccactatttcttacagttcccctcatggtctgagaatatgctggga

SEQ ID NO: 8117 - DNA, 437 bp, Artificial
  TaSBEIIa allele with mutations introduced by TALEN pair TaSBEIIa_T02
  misc_feature (212); (235): n is a or c or t or g
tcagatggatgtgcattctagcaagaacttcacaaaataatgcactgtttgtggtttcgtttgtctgctctacgattgctattttcgtgtgctgtagatacctgaagatatcgaggagcaaacggctgaagtgaacatgacaggggggaccgcagagaaacttgaatcttcagaaccgactcaaaggagttaaggaactagtcgcggggganaaaccgcgagttgtcccaaaacnggagatgggcagaaatatacgagattgacccaacgctgaaagattttcggagccatcttgactaccggtaatgcctaccgctaatttcgctcattttgaattaaggtcctttcatcatgcaaatttggggaacatcaaagaggcaaagactagggaccactatttcatacagttcccctcatggtctgagaatatgctggga

SEQ ID NO: 8118 - DNA, 461 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctacttcgctcattttgaattaaggtcctttcgtcatgcaaattgggaacatcaaagagacaaagactagggaccactattcttacagttcccctcatggtctgagaatatgctggga

SEQ ID NO: 8119 - DNA, 457 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcatcatgcaaatttgggaacatcaaagagacaaagactagggaccaccatttcatacagatcccctcgtggtctgagaatatgctggga

SEQ ID NO: 8120 - DNA, 393 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8121 - DNA, 408 bp, Artificial; identical to SEQ ID NO: 7762
  TaSBEIIa allele with mutations introduced by TALEN pair TaSBEIIa_T02

SEQ ID NO: 8122 - DNA, 450 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcggaaacaatcactgatggtgtaaccaaaggagttaaggaactagtcgtgggggagaaaccgcgagttgtcccaaaaccaggagatgggcagaaatatacgagattgacccaacgctgaaagattttcggagccatcttgactaccggtaatgcctacccgctactttcgctcattttgaattaaggtcctttcgtcatgcaaatttgggaacatcaaagagacaaagactagggaccactatttcttacagttcccctcatggtctgagaatatgctggga

SEQ ID NO: 8123 - DNA, 457 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgaacaatcactgatggtgtaaccaaaggagttaaggaactagtcgtgggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8124 - DNA, 459 bp, Artificial; identical to SEQ ID NO: 8022
  TaSBEIIa allele with mutations introduced by TALEN pair TaSBEIIa_T02

SEQ ID NO: 8125 - DNA, 385 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttctacagttcccctcatggtctgagaatatgctggga

SEQ ID NO: 8126 - DNA, 440 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcactgatggtgtaaccaaaggagttaaggaactagtcgtgggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8127 - DNA, 344 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacaactagtcgtgggggagaaaccgcgagttgtcccaaaaccaggagatgggcagaaaatatacgagattgacccaacgctgaaagattttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 8128 - DNA, 458 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagctagggaccactattcttacagttcccctcatggtctgagaatatgctggga

SEQ ID NO: 8129 - DNA, 463 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcaatcactgatggtgtaaccaaaggagttaaggaactagtcgtgggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8130 - DNA, 421 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaagtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaatttggggaacatcaaagagacaaagactagggaccactatttcttacagttcccctcatggtctgagaatatgctggga

SEQ ID NO: 8131 - DNA, 425 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaccaaaggagttaaggaactagtcgtgggggagaaaccgcgagttgtcccaaaaaccaggagatgggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8132 - DNA, 463 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcatcactgatggtgtaaccaaaggagttaaggaactagtcgcgggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttgggaacatcaaagaggcaaagactagggaccactatttcatacagttcccctcatggtctgagaatatgctggga

SEQ ID NO: 8133 - DNA, 378 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactaggaccactattcttacagttccctcatggtctgagaatatgctggga

SEQ ID NO: 8134 - DNA, 344 bp, Artificial; identical to SEQ ID NO: 7666
  TaSBEIIa allele with mutations introduced by TALEN pair TaSBEIIa_T02

SEQ ID NO: 8135 - DNA, 441 bp, Artificial
  TaSBEIIa allele with mutations introduced by TALEN pair TaSBEIIa_T02
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcaaaaggagttaaggaactagtcgtgggggagaaaccgcgagttgtcccaaaaaccaggagatgggcagaaaatatacgagattgacccaacactgaaagattttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 8136 - DNA, 424 bp, Artificial; identical to SEQ ID NO: 7847
  TaSBEIIa allele with mutations introduced by TALEN pair TaSBEIIa_T02

SEQ ID NO: 8137 - DNA, 457 bp, Artificial; identical to SEQ ID NO: 8062
  TaSBEIIa allele with mutations introduced by TALEN pair TaSBEIIa_T02

SEQ ID NO: 8138 - DNA, 393 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgagaaaccgcgagttgtcccaaaaccaggagatgggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8139 - DNA, 458 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagctagggaccactattcttacagttccctcatggtctgagaatatgctggga

SEQ ID NO: 8140 - DNA, 464 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaagggaacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagatatgctggga

SEQ ID NO: 8141 - DNA, 357 bp, Artificial; identical to SEQ ID NO: 7752
  TaSBEIIa allele with mutations introduced by TALEN pair TaSBEIIa_T02

SEQ ID NO: 8142 - DNA, 458 bp, Artificial
  TaSBEIIa allele with mutations introduced by TALEN pair TaSBEIIa_T02
  misc_feature (231): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgatggtgtaaccaaaggagttaaggaactagtcgtgggggganaaaccgcgagttgtcccaaaaccaggagatgggcagaaaatatacgagattgacccaacgctgaaagattttcggagccatcttgactaccggtaatgcctaccgctactttcgctcattttgaattaaggtcctttcgtcatgcaaatttggggaacatcaaagagacaaagactagggaccactatttcttacagttcccctcatggtctgagaatatgctggga

SEQ ID NO: 8143 - DNA, 454 bp, Artificial
  TaSBEIIa allele with mutations introduced by TALEN pair TaSBEIIa_T02
  misc_feature (228): n is a or c or t or g
tcagatggagtgcattctagcaagaacttcacgaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcactgagtggtgtaaccaaggagttaaggaactagtcgtggggganaaaccgcgagttgtcccaaaaccaggagatgggcagaaaatatacgagattgacccaacgctgaaagattttcggagccatcttgactaccggtaatgcctaccgctactttcgctcattttgaattaaggtcctttcgtcatgcaaatttggggaacatcaagagacaaagactagggaccactatttcttacagttcccctcatggtctgagaatatgctggga

SEQ ID NO: 8144 - DNA, 446 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggagttaaggaactagtcgtgggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8145 - DNA, 424 bp, Artificial
  TaSBEIIa allele with mutations introduced by TALEN pair TaSBEIIa_T02
tcagatggatgtgcttctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcaccaaaggagttaaggaactagtcgtgggggagaaaccgcgagttgtcccaaaaaccaggagatgggcagaaaatatacgagattgacccaacgctgaaagatttcggagccatcttgactaccggtaatgcctaccgctacttcgctcattttgaattaaggtcctttcgtcatgcaaatttggggaacatcaaagagacaaagactagggaccactattcttacagttccctcatggtctgagaatatgctggga

SEQ ID NO: 8146 - DNA, 487 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagatatgctgggactaagactgccaaggcacacaggggatagg

SEQ ID NO: 8147 - DNA, 456 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattcttacagttccctcatggtctgagaatatgctggga

SEQ ID NO: 8148 - DNA, 354 bp, Artificial
  TaSBEIIa allele with mutations introduced by TALEN pair TaSBEIIa_T02
  misc_feature (332): n is a or c or t or g
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaattgtcccgaaaaccaggagatgggcagaaaatatacgagattgacccaacgctgaaagattttcggagccatcttgactaccggtaatgcctaccgctaatttcgctcattttgaattaaggtcctttcatcatgcaaatttggggaacatcaaagaggcaaagactagggaccactatttcatacagttcccctnatggtctgagaatatgctggga

SEQ ID NO: 8149 - DNA, 446 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctattttcgtgtgctgtagatacctgaagatatcgaggagcaaacggctgaagtgaacatgacaggggggaccgcagagaaacttgaatcttcaatcactgatggtgtaaccaaaggagttaaggaactagtcgcgggggagaaaccgcgagttgtcccaaaaccaggagatgggcagaaatatacgagattgacccaacgctgaaagatttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 8150 - DNA, 417 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaattttggggaacatcaaagagacaaagactagggaccactatttcttacagttcccctcatggtctgagaatatgctgggga

SEQ ID NO: 8151 - DNA, 436 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggagttaaggaactagtcgtgggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattcttacagttcccctcatggtctgagatatgctggga

SEQ ID NO: 8152 - DNA, 383 bp, Artificial; identical to SEQ ID NO: 7675
  TaSBEIIa allele with mutations introduced by TALEN pair TaSBEIIa_T02

SEQ ID NO: 8153 - DNA, 200 bp, Artificial; identical to SEQ ID NO: 7622
  TaSBEIIa allele with mutations introduced by TALEN pair TaSBEIIa_T02

SEQ ID NO: 8154 - DNA, 433 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttggatggtgtaaccaaaggagttaaggaactagtcgtgggggagaaaccgcgagttgtacccaaaaccaggagatgggcaagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttccctcatggtctgagaatatgctggga

SEQ ID NO: 8155 - DNA, 442 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcaccaaaggagttaaggaactagtcgtgggggagaaaccgcgagttgtcccaaaaaccaggagatgggcagaaaatatacgagattgacccaacgctgaaagatttcggagccatcttgactaccggtaatgcctaccgctacttcgctcattttgaattaaggtcctttcgtcatgcaaatttgggaacatcaaagagacaaagactagggaccactatttcttacagttccctcatggtctgagaatatgctggga

SEQ ID NO: 8156 - DNA, 389 bp, Artificial
  TaSBEIIa allele with mutations introduced by TALEN pair TaSBEIIa_T02
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaaccgcgagttgtcccaaaaccaggagatgggcagaaaatatacgagattgacccaacactgaaagattttcggagccatcttgactaccggtaatgcctacccgctgctttcgctcattttgaattaaggtcctttcatcatgcaaatttgggaacatcaaagagacaaagactagggaccaccatttcatacagatcccctcgtggtctgagaatatgctggga

SEQ ID NO: 8157 - DNA, 455 bp, Artificial
  TaSBEIIa allele with mutations introduced by TALEN pair TaSBEIIa_T02
  misc_feature (225): n is a or c or t or g
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaacaatcactgatggtgtaaccaaaggagttaaggaactagtcgtggggganaaaccgcgagttgtcccaaaaccaggagatgggcagaaaatatacgagattgacccaacactgaaagattttcggagccatcttgactaccggtaatgcctacccgctgcttttcgctcatttttgaatttaaggtcctttcatcatgcaaatttggggaacatcaaagagacaaagactagggaccaccatttcatacagatccctcgtggtctgagaatatgctggga

SEQ ID NO: 8158 - DNA, 428 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttgggaacatcaaagagacaaagactagggaccactatttcttacagttccctcatggtctgagaatatgctggga

SEQ ID NO: 8159 - DNA, 409 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttccctcatggtctgagaatatgctggga

SEQ ID NO: 8160 - DNA, 378 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtgaactagtcgtgggggagaaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8161 - DNA, 432 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgatggtgtaaccaaaggagttaaggaactagtcgtgggggagaaaccgcgagttgtcccaaaaaccaggagatgggcagaaaatatacgagattgacccaacgctgaaaagattttcggagccatcttgactaccggtaatgcctacccgctactttcgctcattttgaattaaggtcctttcgtcatgcaaatttgggaacatcaaagagacaaagactagggaccactaatttcttacagttccctcatggtctgagaatatgctggga

SEQ ID NO: 8162 - DNA, 456 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctaccgctactttcgctcattttgaattaaggtcctttcgtcatgcaaatttggggaacatcaaagagacaaagactagggaccactattcttacagttcccctcatggtctgagaatatgctggga

SEQ ID NO: 8163 - DNA, 449 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcataaccaaaggagttaaggaactagtcgtgggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattcttacagttcccctcatggtctgagaatatgctggga

SEQ ID NO: 8164 - DNA, 457 bp, Artificial; identical to SEQ ID NO: 7837
  TaSBEIIa allele with mutations introduced by TALEN pair TaSBEIIa_T02
  misc_feature (230): n is a or c or t or g

SEQ ID NO: 8165 - DNA, 457 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttgggaacatcaaagagacaaagactagggaccactatttcttacagttcccctcatggtctgagaatatgctggga

SEQ ID NO: 8166 - DNA, 200 bp, Artificial; identical to SEQ ID NO: 7622
  TaSBEIIa allele with mutations introduced by TALEN pair TaSBEIIa_T02

SEQ ID NO: 8167 - DNA, 376 bp, Artificial; identical to SEQ ID NO: 7660
  TaSBEIIa allele with mutations introduced by TALEN pair TaSBEIIa_T02

SEQ ID NO: 8168 - DNA, 457 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctaccgctactttcgctcattttgaattaaggtcctttcgtcatgcaaatttggggaacatcaaagagacaaagactagggaccactatttcttacagttcccctcatggtctgagaatatgctggga

SEQ ID NO: 8169 - DNA, 407 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatctagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattcttacagttcccctcatggtctgagaatatgctggga

SEQ ID NO: 8170 - DNA, 415 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8171 - DNA, 457 bp, Artificial
  TaSBEIIa allele with mutations introduced by TALEN pair TaSBEIIa_T02
  misc_feature (230): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgatggtgtaaccaaaggagttaaggaactagtcgtggggganaaaccgcgagttgtcccaaaaccaggagatgggcagaaaatatacgagattgacccaacgctgaaagattttcggagccatcttgactaccggtaatgcctaccgctactttcgctcattttgaattaaggtcctttcgtcatgcaaatttggggaacatcaaagagacaaagactagggaccactatttcttacagttcccctcatggtctgagaatatgctggga

SEQ ID NO: 8172 - DNA, 469 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgcaatcactgatggtgtaaccaaaggagttaaggaactagtcgcgggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagatatgctggga

SEQ ID NO: 8173 - DNA, 416 bp, Artificial; identical to SEQ ID NO: 7771
  TaSBEIIa allele with mutations introduced by TALEN pair TaSBEIIa_T02

SEQ ID NO: 8174 - DNA, 424 bp, Artificial; identical to SEQ ID NO: 7847
  TaSBEIIa allele with mutations introduced by TALEN pair TaSBEIIa_T02

SEQ ID NO: 8175 - DNA, 376 bp, Artificial; identical to SEQ ID NO: 7693
  TaSBEIIa allele with mutations introduced by TALEN pair TaSBEIIa_T02

SEQ ID NO: 8176 - DNA, 384 bp, Artificial; identical to SEQ ID NO: 7781
  TaSBEIIa allele with mutations introduced by TALEN pair TaSBEIIa_T02

SEQ ID NO: 8177 - DNA, 458 bp, Artificial
  TaSBEIIa allele with mutations introduced by TALEN pair TaSBEIIa_T02
  misc_feature (229): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggtgtaaccaaaggagttaaggaactagtcgtggggganaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8178 - DNA, 412 bp, Artificial
  TaSBEIIa allele with mutations introduced by TALEN pair TaSBEIIa_T02
tcagatggatgtgcattactagcaagaacttcacgaaataatgcactgtttgtggtttcgttagtctgctctacaattgctattttcgtgctgtagatacctgaagacatcgaggagcaaacggctgaagtaaacatgacaggggggactgcaaaggagttaaggaactagtcgtgggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctgggga

SEQ ID NO: 8179 - DNA, 449 bp, Artificial; identical to SEQ ID NO: 7962
  TaSBEIIa allele with mutations introduced by TALEN pair TaSBEIIa_T02

SEQ ID NO: 8180 - DNA, 454 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcactgatggtgtaaccaaaggagttaaggaactagtcgtgggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8181 - DNA, 380 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttgggaacatcaaagagacaaagactagggaccactatttcttacagttcccctcatggtctgagaatatgctggga

SEQ ID NO: 8182 - DNA, 462 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtccttttcgtcatgcaaatttggggaacatcaaagagacaaagactagggaccactatttctacagttcccctcatggtctgagaatatgctggga

SEQ ID NO: 8183 - DNA, 367 bp, Artificial; identical to SEQ ID NO: 7647
  TaSBEIIa allele with mutations introduced by TALEN pair TaSBEIIa_T02

SEQ ID NO: 8184 - DNA, 419 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagagaaacttcaatcagttaaggaactagtcgtgggggagaaaccgcgagttgtcccaaaaaccaggagatgggcagaaaatatacgagattgacccaacactgaaagattttcggagccatcttgactaccggtaatgcctacccgctgctttcgctcattttgaattaaggtcctttcatcatgcaaatttgggaacatcaaagagacaaagactagggaccaccatttcatacagatcccctcgtggtctgagaatatgctggga

SEQ ID NO: 8185 - DNA, 411 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttaaggaactagtcgtgggggagaaaccgcgagttgtcccaaaaaccaggagatgggcagaaaatatacgagattgacccaacgctgaaagatttcggagccatcttgactaccggtaatgcctaccgctacttcgctcattttgaattaaggtccttcgtcatgcaaatttgggaacatcaaagagacaaagactagggaccactattcttacagttccctcatggtctgagaatatgctggga

SEQ ID NO: 8186 - DNA, 357 bp, Artificial; identical to SEQ ID NO: 7752
  TaSBEIIa allele with mutations introduced by TALEN pair TaSBEIIa_T02

SEQ ID NO: 8187 - DNA, 449 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggacccactatttcttacagttcccctcatggtctgagaatatgctggga

SEQ ID NO: 8188 - DNA, 424 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcaaaggagttaaggaactagtcgtgggggagaaaccgcgagttgtcccaaaaccaggagatgggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactaggaccactatttcttacagttcccctcatggtctgagaatatgctggga

SEQ ID NO: 8189 - DNA, 463 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgcaatcactgatggtgtaaccaaggagttaaggaactagtcgtggggagaaaccgcgagttgtcccaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagatatgctggga

SEQ ID NO: 8190 - DNA, 461 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8191 - DNA, 456 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgaacaatcactgatggtgtaaccaaaggagttaaggaactagtcgtgggggagaaaccgcgagttgtcccaaaaaccaggagatgggcagaaaatatacgagattgacccaacgctgaaagattttcggagccatcttgactaccggtaatgcctaccgctactttcgctcattttgaattaaggtcctttcgtcatgcaaatttggggaacatcaaagagacaaagactagggaccactatttcttacagttcccctcatggtctgagaatatgctggga

SEQ ID NO: 8192 - DNA, 461 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8193 - DNA, 344 bp, Artificial; identical to SEQ ID NO: 8127
  TaSBEIIa allele with mutations introduced by TALEN pair TaSBEIIa_T02

SEQ ID NO: 8194 - DNA, 455 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtgtaaccaaaggagttaaggaactagtcgtgggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8195 - DNA, 454 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcatggtgtaaccaaaggagttaaggaactagtcgtgggggagaaaccgcgagttgtcccaaaaaccaggagatgggcagaaaatatacgagattgacccaacgctgaaagattttcggagccatcttgactaccggtaatgcctacccgctacttcgctcattttgaattaaggtcctttcgtcatgcaaatttggggaacatcaaagagacaaagactagggaccactatttcttacagttcccctcatggtctgagaatatgctggga

SEQ ID NO: 8196 - DNA, 450 bp, Artificial
  TaSBEIIa allele with mutations introduced by TALEN pair TaSBEIIa_T02
  misc_feature (246): n is a or c or t or g
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcaatcactgatggtgtaaccaaaggagttaaggaactagtcgcgggggagaaaccgcgagttgtcccaaaaaccnggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 8197 - DNA, 345 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaaagactagggaccactatttcttacagttcccctcatggtctgagaatatgctggga

SEQ ID NO: 8198 - DNA, 407 bp, Artificial
  TaSBEIIa allele with mutations introduced by TALEN pair TaSBEIIa_T02
  misc_feature (384): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaactgaactagtcgtgggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttctacagttcccctnatggtctgagaatatgctgggga

SEQ ID NO: 8199 - DNA, 390 bp, Artificial
  TaSBEIIa allele with mutations introduced by TALEN pair TaSBEIIa_T02
  misc_feature (368): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgagaaaccgcgagttgtcccaaaaccaggagatgggcagaaaatatacgagattgacccaacgctgaaagatttcggagccatcttgactaccggtaatgcctaccgctactttcgctcattttgaattaaggtcctttcgtcatgcaaaatttggggaacatcaaagagacaaagactagggaccactattcttacagttcccctnatggtctgagaatatgctggga

SEQ ID NO: 8200 - DNA, 464 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcattgcaaatttggggaacatcaaagagacaaagactagggaccactatttcttacagttcccctcatggtctgagaatatgctggga

SEQ ID NO: 8201 - DNA, 422 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactagtcgtgggggagaaaccgcgagttgtcccaaaaaccaggagatgggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8202 - DNA, 408 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaattagtcgtgggggagaaaccgcgagttgtcccaaaaaccaggagatgggcagaaaaatatacgagattgacccaacgctgaaagattttcggagccatcttgactaccggtaatgcctaccgctactttcgctcattttgaattaaggtcctttcgtcatgcaaatttggggaacatcaaagagacaaagactagggaccactatttcttacagttcccctcatggtctgagaatatgctggga

SEQ ID NO: 8203 - DNA, 367 bp, Artificial; identical to SEQ ID NO: 7647
  TaSBEIIa allele with mutations introduced by TALEN pair TaSBEIIa_T02

SEQ ID NO: 8204 - DNA, 455 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctaccgctactttcgctcattttgaattaaggtcctttcgtcatgcaaatttggggaacatcaaagagacaaagactagggaccactatttcttacagttccctcatggtctgagaatatgctggga

SEQ ID NO: 8205 - DNA, 318 bp, Artificial
  TaSBEIIa allele with mutations introduced by TALEN pair TaSBEIIa_T02
tcagatggatgtacattctagcaagaacttcacaacataatgcaccgtttggggtttcgtcagtctgctctacaattgctatttttcgtgctgtagatagttgtcccaaaaccaggagatgggcagaaaatatacgagattgacccaacactgaaagattttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 8206 - DNA, 448 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8207 - DNA, 423 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8208 - DNA, 425 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgggggagaaaccgcgagttgtcccaaaaaccaggagatgggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8209 - DNA, 345 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattcttacagttcccctcatggtctgagaatatgctggga

SEQ ID NO: 8210 - DNA, 386 bp, Artificial
  TaSBEIIa allele with mutations introduced by TALEN pair TaSBEIIa_T02
  misc_feature (364): n is a or c or t or g
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctnatggtctgagaatatgctggga

SEQ ID NO: 8211 - DNA, 458 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacacgttccctcatggtctgagaatatgctggga

SEQ ID NO: 8212 - DNA, 416 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttaaggaactagtcgtggggagaaaccgcgagttgtcccaaaaaccaggagatgggcagaaaatatacgagattgacccaacgctgaaagatttcggagccatcttgactaccggtaatgcctacccgctactttcgctcattttgaattaaggtacctttcgtcatgcaaatttgggaacatcaaagagacaaagactagggaccactatttcttacagttcccctcatggtctgagaatatgctggga

SEQ ID NO: 8213 - DNA, 376 bp, Artificial; identical to SEQ ID NO: 7657
  TaSBEIIa allele with mutations introduced by TALEN pair TaSBEIIa_T02

SEQ ID NO: 8214 - DNA, 377 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtgaactagtcgtgggggagaaaccgcgagttgtcccaaaaccaggagatgggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8215 - DNA, 436 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8216 - DNA, 448 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcaccaaaggagttaaggaactagtcgtgggggagaaaccgcgagttgtcccaaaaaccaggagatgggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8217 - DNA, 447 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagatatgctggga

SEQ ID NO: 8218 - DNA, 386 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcgtcatgcaaatttggggaacatcaaagagacaaagactagggaccactatttcttacagttcccctcatggtctgagaatatgctggga

SEQ ID NO: 8219 - DNA, 384 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8220 - DNA, 444 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcaccaaaggagttaaggaactagtcgtgggggagaaaccgcgagttgtcccaaaaaccaggagatgggcagaaaatatacgagattgacccaacgctgaaagattttcggagccatcttgactaccggtaatgcctaccgctactttcgctcattttgaattaaggtcctttcgtcatgcaaatttggggaacatcaaagagacaaagactagggacactatttcttacagttccctcatggtctgagaatatgctggga

SEQ ID NO: 8221 - DNA, 454 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8222 - DNA, 443 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtccttcgtcatgcaaatttggggaacatcaaagagacaaagactagggaccactatttctacagttcccctcatggtctgagaatatgctggga

SEQ ID NO: 8223 - DNA, 438 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcactgatggtgtaaccaaaggagttaaggaactagtcgtgggggagaaaccgcgagttgtcccaaaaaccaggagatgggcagaaatatacgagattgacccaacgctgaaagatttcggagccatcttgactaccggtaatgcctacccgctactttcgctcattttgaattaaggtcctttcgtcatgcaaatttgggaacatcaaaagagacaaagactagggaccactatttcttacagttcccctcatggtctgagaatatgctggga

SEQ ID NO: 8224 - DNA, 326 bp, Artificial; identical to SEQ ID NO: 7855
  TaSBEIIa allele with mutations introduced by TALEN pair TaSBEIIa_T02

SEQ ID NO: 8225 - DNA, 200 bp, Artificial; identical to SEQ ID NO: 7622
  TaSBEIIa allele with mutations introduced by TALEN pair TaSBEIIa_T02

SEQ ID NO: 8226 - DNA, 459 bp, Artificial
  TaSBEIIa allele with mutations introduced by TALEN pair TaSBEIIa_T02
  misc_feature (233): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcatcactgatggtgtaaccaaaggagttaaggaactagtcgtggggganaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattcttacagttcccctcatggtctgagatatgctggga

SEQ ID NO: 8227 - DNA, 473 bp, Artificial
  TaSBEIIa allele with mutations introduced by TALEN pair TaSBEIIa_T02
  misc_feature (449): n is a or c or t or g
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgcaatcactgatggtgtaaccaaaggagttaaggaactagtcgcgggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttccccctnatggtctgaagaatatgcgtggga

SEQ ID NO: 8228 - DNA, 441 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctaccgctacttcgctcattttgaattaaggtcctttcgtcatgcaaatttggggaacatcaaagagacaaagactagggaccactatttcttacagttcccctcatggtctgagaatatgctggga

SEQ ID NO: 8229 - DNA, 346 bp, Artificial; identical to SEQ ID NO: 7742
  TaSBEIIa allele with mutations introduced by TALEN pair TaSBEIIa_T02

SEQ ID NO: 8230 - DNA, 470 bp, Artificial; identical to SEQ ID NO: 7331
  TaSBEIIa allele with mutations introduced by TALEN pair TaSBEIIa_T02

SEQ ID NO: 8231 - DNA, 419 bp, Artificial
  TaSBEIIa allele with mutations introduced by TALEN pair TaSBEIIa_T02
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcagttaaggaactagtcgtgggggagaaaccgcgagttgtcccaaaaccaggagatgggcagaaaatatacgagattgacccaacactgaaagattttcggagccatcttgactaccggtaatgcctacccgctgctttcgctcattttgaattaaggtcctttcatcatgcaaatttgggaacatcaaagagacaaagactagggaccaccatttcatacagatcccctcgtggtctgagaatatgctggga

SEQ ID NO: 8232 - DNA, 457 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggatcactgatggtgtaaccaaaggagttaaggaactagtcgtgggggagaaaccgcgagttgtcccaaaccaggagatgggcagaaaatatacgagattgacccaacgctgaaagattttcggagccatcttgactaccggtaatgcctacccgctacttcgctcattttgaattaaggtcctttcgtcatgcaaatttggggaacatcaaagagacaaagactagggaccactatttcttacagttcccctcatggtctgagatatgctggga

SEQ ID NO: 8233 - DNA, 421 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaagtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattcttacagttcccctcatggtctgagaatatgctggga

SEQ ID NO: 8234 - DNA, 418 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaaatcttaaggaactagtcgtgggggagaaaccgcgagttgtcccaaaaaccaggagatgggcagaaaatatacgagattgacccaacgctgaaagattttcggagccatcttgactaccggtaatgcctaccgctactttcgctcattttgaattaaggtcctttcgtcatgcaaatttggggaacatcaaagagacaaagactagggaccactatttcttacagttcccctcatggtctgagaatatgctggga

SEQ ID NO: 8235 - DNA, 455 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactaggaccactatttctacagttcccctcatggtctgagaatatgctggga

SEQ ID NO: 8236 - DNA, 418 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaattttggggaacatcaaagagacaaagactagggaccactatttcttacagttcccctcactggtctgagaatatgctggga

SEQ ID NO: 8237 - DNA, 452 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctacttcgctcattttgaattaaggtcctttcgtcatgcaaatttggggaacatcaaagagacaaagactaggaccactattcttacagttcccctcatgtctgagatatgctggga

SEQ ID NO: 8238 - DNA, 458 bp, Artificial; identical to SEQ ID NO: 8039
  TaSBEIIa allele with mutations introduced by TALEN pair TaSBEIIa_T02

SEQ ID NO: 8239 - DNA, 460 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggacgtgcagaaaaacttagaatcttcagaaccgactcaatcactgatggtgtaaccaaaggagttaaggaactagtcgtgggggagaaaccgcgagttgtcccaaaaccaggagatgggcagaaaactatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8240 - DNA, 392 bp, Artificial; identical to SEQ ID NO: 7703
  TaSBEIIa allele with mutations introduced by TALEN pair TaSBEIIa_T02

SEQ ID NO: 8241 - DNA, 426 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattggagaaaccgcgagttgtcccaaaaaccaggagatgggcaagaaaaatatacgagattgacccaacgctgaaagattttcggagccatcttgactaccggtaatgcctacccgctaatttcgctcattttgaattaaggtcctttcatcatgcaaatttgggaacatcaaagaggcaaagactagggaccactatttcatacagttccccctcatggtctgagaatatgctggga

SEQ ID NO: 8242 - DNA, 456 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcatttgaattaaggtcctttcgtcatgcaaatttggggaacatcaaagagacaaagactagggaccactattcttacagttcccctcatggtctgagatatgctggga

SEQ ID NO: 8243 - DNA, 367 bp, Artificial; identical to SEQ ID NO: 7647
  TaSBEIIa allele with mutations introduced by TALEN pair TaSBEIIa_T02

SEQ ID NO: 8244 - DNA, 439 bp, Artificial; identical to SEQ ID NO: 7917
  TaSBEIIa allele with mutations introduced by TALEN pair TaSBEIIa_T02

SEQ ID NO: 8245 - DNA, 345 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactaggaccactatttcttacagttcccctcatggtctgagaatatgctggga

SEQ ID NO: 8246 - DNA, 453 bp, Artificial
  TaSBEIIa allele with mutations introduced by TALEN pair TaSBEIIa_T02
  misc_feature (225): n is a or c or t or g
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaacaatcactgatggtgtaaccaaaggagttaaggaactagtcgtggggganaaaccgcgagttgtcccaaaaacaggagatgggcagaaaatatacgagattgacccaacactgaaagattttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 8247 - DNA, 463 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcatcactgatggtgtaaccaaaggagttaaggaactagtcgcggggggagaaaccgcgagttgtcccaaaaccaggagatgggcagaaaatatacgagattgacccaacgctgaaagattttcggagccatcttgactaccggtaatgcctacccgctaatttcgctcattttgaattaaggtccttcatcatgcaaatttggggaacatcaaagaggcaaagactagggaccactatttcatacagttccccctcatggtctgagaatatgctgg

SEQ ID NO: 8248 - DNA, 466 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcatcactgatggtgtaaccaaaggagttaaggaactagtcgcgggggagaaaccgcgagttgtcccaaaaccaggagatgggcagaaaatatacgagattgacccaaacgctagaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 8249 - DNA, 417 bp, Artificial
  TaSBEIIa allele with mutations introduced by TALEN pair TaSBEIIa_T02
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccagtcgtgggggagaaaccgcgagttgtcccaaaaccaggagatgggcagaaaatatacgagattgacccaacactgaaagattttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 8250 - DNA, 451 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcggtgtaaccaaaggagttaaggaactagtcgtggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattcttacagttcccctcatggtctgagaatatgctggga

SEQ ID NO: 8251 - DNA, 447 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaaatttggggaacatcaaaagagacaaagactagggaccactatttctacagttcccctcatggtctgagaatatgctggga

SEQ ID NO: 8252 - DNA, 419 bp, Artificial
  TaSBEIIa allele with mutations introduced by TALEN pair TaSBEIIa_T02
  misc_feature (214); (397): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagtgtaaccaaaggagttaaggaactagtcgtgggggagaaaccgcgagttgtcccaaaaccnggagatgggcagaaaatatacgagattgacccaacgctgaaagattttcggagccatcttgactaccggtaatgcctacccgctactttcgctcattttgaattaaggtccttttcgtcatgcaaatttggggaacatcaaagagacaaagactagggaccactatttcttacagttcccctnatggtctgagaatatgctggga

SEQ ID NO: 8253 - DNA, 423 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgggggagaaaccgcgagttgtcccaaaaccaggagatgggcagaaaatatacgagattgacccaacgctgaaagattttcggagccatcttgactaccggtaatgcctacccgctactttcgctcattttgattaaggtcctttcgtcatgcaaattttggggaacatcaaagagacaaagactagggaccactatttcttacagttcccctcatggtctgagaatatgctggga

SEQ ID NO: 8254 - DNA, 424 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcaaaggagttaaggaactagtcgtgggggagaaaccgcgagttgtcccaaaaaccaggagatgggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattcttacagttccctcatggtctgagaatatgctggga

SEQ ID NO: 8255 - DNA, 453 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcactgatggtgtaaccaaaggagttaaggaactagtcgtgggggagaaaccgcgagttgtcccaaaaaccaggagatgggcagaaaatatacgagattgacccaacgctgaaagattttcggagccatcttgactaccggtaatgcctaccgctactttcgctcattttgaattaaggtcctttcgtcatgcaaatttggggaacatcaaagagacaaagactagggaccactatttcttacagttcccctcatggtctgagaatatgctggga

SEQ ID NO: 8256 - DNA, 432 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttggatggtgtaaccaaaggagttaaggaactagtcgtgggggagaaaccgcgagttgtcccaaaaccaggagatgggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttccctcatggtctgagaatatgctggga

SEQ ID NO: 8257 - DNA, 437 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattcttacagttcccctcatggtctgagaatatgctggga

SEQ ID NO: 8258 - DNA, 374 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtgaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttgggaacatcaaagagacaaagactaggaccactatttcttacagttcccctcatggtctgagaatatgctggga

SEQ ID NO: 8259 - DNA, 462 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaagggaacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcatttgaattaaggtcctttcgtcatgcaaatttggggaacatcaaagagacaaagactagggaccactattcttacagttccctcatggtctgagaatatgctggga

SEQ ID NO: 8260 - DNA, 406 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaactgaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8261 - DNA, 354 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaattgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 8262 - DNA, 462 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttacgtcatgcaaatttgggaacatcaaagagacaaagactagggaccactatttcttacagttcccctcatggtctgagaatatgctggga

SEQ ID NO: 8263 - DNA, 456 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcactgatggtgtaaccaaaggagttaaggaactagtcgtgggggagaaaccgcgagttgtcccaaaaaccaggagatgggcagaaaatatacgagattgacccaacgctgaaagattttcggagccatcttgactaccggtaatgcctaccgctactttcgctcattttgaattaaggtcctttcatcatgcaaatttgggaacatcaaagaggcaaagactagggaccactattcatacagttcccctcatggtctgagaatatgctggga

SEQ ID NO: 8264 - DNA, 449 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcataaccaaaggagttaaggaactagtcgtgggggagaaaccgcgagttgtcccaaaaaccaggagatgggcagaaaatatacgagattgacccaacgctgaaagattttcggagccatcttgactaccggtaatgcctacccgctacttcgctcattttgaattaaggtcctttcgtcatgcaaatttggggaacatcaaagagacaaagactagggaccactatttcttacagttcccctcatggtctgagaatatgctggga

SEQ ID NO: 8265 - DNA, 450 bp, Artificial
  TaSBEIIa allele with mutations introduced by TALEN pair TaSBEIIa_T02
  misc_feature (221); (246): n is a or c or t or g
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcaatcactgatggtgtaaccaaaggagttaaggaactagtcgcggggganaaaccgcgagttgtcccaaaaaccnggagatgggcagaaatatacgagattgacccaacgctagaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 8266 - DNA, 199 bp, Artificial; identical to SEQ ID NO: 7614
  TaSBEIIa allele with mutations introduced by TALEN pair TaSBEIIa_T02

SEQ ID NO: 8267 - DNA, 459 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaggtcctttcgtcatgcaaatttgggaacatcaaagagacaaagactagggaccactatttcttacagttcccctcatggtctgagaatatgctggga

SEQ ID NO: 8268 - DNA, 454 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtgtaaccaaaggagttaaggaactagtcgtgggggagaaaccgcgagttgtcccaaaaaccaggagatgggcagaaaaatatacgagattgacccaacgctgaaagattttcggagccatcttgactaccggtaatgcctaccgctacttcgctcattttgaattaaggtcctttcgtcatgcaaatttggggaacatcaaagagacaaagactagggaccactatttcttacagttcccctcatggtctgagaatatgctggga

SEQ ID NO: 8269 - DNA, 346 bp, Artificial; identical to SEQ ID NO: 7742
  TaSBEIIa allele with mutations introduced by TALEN pair TaSBEIIa_T02

SEQ ID NO: 8270 - DNA, 456 bp, Artificial
  TaSBEIIa allele with mutations introduced by TALEN pair TaSBEIIa_T02
  misc_feature (228): n is a or c or t or g
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggactgcagagaaacttcaatcttcagaaccgactcactgatggtgtaaccaaaggagttaaggaactagtcgtggggganaaaccgcgagttgtcccaaaaccaggagatgggcagaaaatatacgagattgacccaacactgaaagattttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 8271 - DNA, 391 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaattttggggaacatcaaagagacaaagactagggaccactatttcttacagttcccctcatggtctgagaatatgctggga

SEQ ID NO: 8272 - DNA, 415 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgagttaaggaactagtcgtgggggagaaaccgcgagttgtcccaaaaaccaggagatgggcaagaaaatatacgagattgacccaacgctgaaagattttcggagccatcttgactaccggtaatgcctaccgctactttcgctcattttgaattaaggtcctttcgtcatgcaaatttggggaacatcaaagagacaaagactagggaccactattcttacagttcccctcatggtctgagaatatgctggga

SEQ ID NO: 8273 - DNA, 409 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatctagtcgtgggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8274 - DNA, 200 bp, Artificial; identical to SEQ ID NO: 7622
  TaSBEIIa allele with mutations introduced by TALEN pair TaSBEIIa_T02

SEQ ID NO: 8275 - DNA, 458 bp, Artificial; identical to SEQ ID NO: 7407
  TaSBEIIa allele with mutations introduced by TALEN pair TaSBEIIa_T02

SEQ ID NO: 8276 - DNA, 444 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactatggtgtaaccaaaggagttaaggaactagtcgtgggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaattggggaacatcaaagagacaaagactaggacactattcttacagttccctcatggtctgagaatatgctggga

SEQ ID NO: 8277 - DNA, 446 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactatggtgtaaccaaaggagttaaggaactagtcgtgggggagaaaccgcgagttgtcccaaaaccaggagatgggcagaaaatatacgagattgacccaacgctgaaagatttcggagccatcttgactaccggtaatgcctaccgctactttcgctcattttgaattaaggtcctttcgtcatgcaaatttggggaacatcaaagagacaaagactagggaccactatttcttacagttcccctcatggtctgagaatatgctggga

SEQ ID NO: 8278 - DNA, 383 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaaccgcgagttgtcccaaaaccaggagatgggcagaaaatatacgagattgacccaacgctgaaagattttcggagccatcttgactaccggtaatgcctacccgctactttcgctcattttgaattaaggtcctttacgtcatgcaaatttgggaacatcaaagagacaaagactagggaccactatttcttacagttcccctcatggtctgagaatatgctggga

SEQ ID NO: 8279 - DNA, 429 bp, Artificial; identical to SEQ ID NO: 7686
  TaSBEIIa allele with mutations introduced by TALEN pair TaSBEIIa_T02

SEQ ID NO: 8280 - DNA, 408 bp, Artificial; identical to SEQ ID NO: 7762
  TaSBEIIa allele with mutations introduced by TALEN pair TaSBEIIa_T02

SEQ ID NO: 8281 - DNA, 389 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaaaccgcgagttgtcccaaaaccaggagatgggcagaaaatatacgagattgacccaacgctgaaagatttcggagccatcttgactaccggtaatgcctacccgctactttcgctcattttgaattaaggtcctttcgtcatgcaaatttggggaacatcaaaagagacaaagactagggaccactatttctacagttcccctcatggtctgagaatatgctggga

SEQ ID NO: 8282 - DNA, 452 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgatcactgatggtgtaaccaaaggagttaaggaactagtcgtgggggagaaaccgcgagttgtcccaaaaaccaggagatgggcagaaaatatacgagattgacccaacgctgaaagattttcggagccatcttgactaccggtaatgcctaccgctactttcgctcattttgaattaaggtcctttcgtcatgcaaatttggggaacatcaaagagacaaagactagggaccactatttcttacagttcccctcatggtctgagaatatgctggga

SEQ ID NO: 8283 - DNA, 457 bp, Artificial; identical to SEQ ID NO: 8168
  TaSBEIIa allele with mutations introduced by TALEN pair TaSBEIIa_T02

SEQ ID NO: 8284 - DNA, 421 bp, Artificial; identical to SEQ ID NO: 8036
  TaSBEIIa allele with mutations introduced by TALEN pair TaSBEIIa_T02

SEQ ID NO: 8285 - DNA, 420 bp, Artificial
  TaSBEIIa allele with mutations introduced by TALEN pair TaSBEIIa_T02
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcagttaaggaactagtcgtgggggagaaaccgcgagttgtcccaaaaccaggagatgggcagaaaaatatacgagattgacccaacactgaaagattttcggagccatcttgactaccggtaatgcctacccgctgctttcgctcattttgaattaaggtcctttcatcatgcaaatttgggaacatcaaagagacaaagactagggaccaccatttcatacagatcccctcgtggtctgagaatatgctggga

SEQ ID NO: 8286 - DNA, 431 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttctacagttcccctcatggtctgagaatagctggga

SEQ ID NO: 8287 - DNA, 435 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggagttaaggaactagtcgtgggggagaaaccgcgagttgtcccaaaaccaggagatgggcagaaaatatacgagattgacccaacgctgaaagatttcggagccatcttgactaccggtaatgcctacccgctactttcgctcattttgaattaaggtcctttcgtcatgcaaatttggggaacatcaaagagacaaagactagggaccactatttctacagttcccctcatggtctgagaatatgctggga

SEQ ID NO: 8288 - DNA, 376 bp, Artificial; identical to SEQ ID NO: 7657
  TaSBEIIa allele with mutations introduced by TALEN pair TaSBEIIa_T02

SEQ ID NO: 8289 - DNA, 439 bp, Artificial; identical to SEQ ID NO: 7917
  TaSBEIIa allele with mutations introduced by TALEN pair TaSBEIIa_T02

SEQ ID NO: 8290 - DNA, 450 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgatcactgatggtgtaaccaaaggagttaaggaactagtcgtgggggagaaaccgcgagttgtcccaaaaccaggagatgggcagaaatatacgagattgacccaacgctgaaagattttcggagccatcttgactaccggtaatgcctaccgctactttcgctcattttgaattaaggtcctttcgtcatgcaaatttggggaacatcaaagagacaaagactagggaccactatttcttacagttcccctcatggtctgagaatatgctggga

SEQ ID NO: 8291 - DNA, 417 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttggagttaaggaactagtcgtgggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8292 - DNA, 409 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatctagtcgtgggggagaaaccgcgagttgtcccaaaaaccaggagatgggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttccctcatggtctgagaatatgctggga

SEQ ID NO: 8293 - DNA, 344 bp, Artificial; identical to SEQ ID NO: 7666
  TaSBEIIa allele with mutations introduced by TALEN pair TaSBEIIa_T02

SEQ ID NO: 8294 - DNA, 405 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatctagtcgtgggggagaaaccgcgagttgtcccaaaaccaggagatgggcagaaaatatacgagattgacccaacgctgaaagattttcggagccatcttgactaccggtaatgcctaccgctactttcgctcattttgaattaaggtcctttcgtcatgcaaatttggggaacatcaaagagacaaagactagggaccactattcttacagttccctcatggtctgagaatatgctggga

SEQ ID NO: 8295 - DNA, 461 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaggtccttcgtcatgcaaatttgggaacatcaaagagacaaagactagggaccactatttcttacagttccctcatggtctgagaatatgctggga

SEQ ID NO: 8296 - DNA, 459 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttgggaacatcaaagagacaaagactagggaccactattcttacagttccctcatggtctgagaatatgctggga

SEQ ID NO: 8297 - DNA, 460 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgatggtgtaaccaaaggagttaaggaactagtcgtgggggagaaaccgcgagttgtcccaaaaccaggagatgggcagaaaatatacgagattgacccaacgctagaaagattttcggagccatcttgactaccggtaatgcctacccgctactttcgctcattttgaattaaggtcctttcgtcatgcaaatttggggaacatcaaagagaacaaagactagggaccactatttcttacagttcccctcatggtctgagaatatgctggga

SEQ ID NO: 8298 - DNA, 458 bp, Artificial
  TaSBEIIa allele with mutations introduced by TALEN pair TaSBEIIa_T02
  misc_feature (450): n is a or c or t or g
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcactgatggtgtaaccaaaggagttaaggaactagtcgcggggggagaaaccgcgagttgtcccaaaaaccaggagatgggcaagaaaatatacgagattgacccaacgctgaaagattttcggagccatcttgactaccggtaatgcctaccgctaatttcgctcattttgaattaaggtcctttcatcatgcaaatttggggaacatcaaagaggcaaagactagggaccactatttcatacagttcccctcatggtctgagaatntgctggga

SEQ ID NO: 8299 - DNA, 408 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattcttacagttcccctcatggtctgagaatatgctggga

SEQ ID NO: 8300 - DNA, 459 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8301 - DNA, 443 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8302 - DNA, 458 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgaacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaatttaaggtcctttcgtcatgcaaatttggggaacatcaaagagacaaagactagggaccactatttcttacagttcccctcactggtctgagaatatgctggga

SEQ ID NO: 8303 - DNA, 453 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactaggggaccactattcttacagttcccctcatggtctgagaatatgctggga

SEQ ID NO: 8304 - DNA, 452 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattcttacagttcccctcatggtctgagaatatgctggga

SEQ ID NO: 8305 - DNA, 454 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctaccggctactttcgctcattttgaattaaggtcctttcgtcatgcaaatttggggaacatcaaagagacaaagactagggaccactatttcttacagttcccctcatggtctgagaatatgctgga

SEQ ID NO: 8306 - DNA, 407 bp, Artificial; identical to SEQ ID NO: 7707
  TaSBEIIa allele with mutations introduced by TALEN pair TaSBEIIa_T02

SEQ ID NO: 8307 - DNA, 440 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcactgatggtgtaaccaaaggagttaaggaactagtcgtggggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggacactatttcttacagttcccctcactggtctgagatatgctggga

SEQ ID NO: 8308 - DNA, 446 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcaatcactgatggtgtaaccaaaggagttaaggaactagtcgtgggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaaagagacaaagactagggacccactatttcttacagttcccctcatggtctgagaatatgctggga

SEQ ID NO: 8309 - DNA, 455 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctaccgctactttcgctcattttgaattaaggtcctttcgtcatgcaaatttgggaacatcaaagagacaaagactagggaccactatttcttacagttcccctcatggtctgagaatatgctggga

SEQ ID NO: 8310 - DNA, 406 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaattagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattcttacagttcccctcatggtctgagaatatgctggga

SEQ ID NO: 8311 - DNA, 456 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattcttacagttccctcatggtctgagaatatgctggga

SEQ ID NO: 8312 - DNA, 462 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttcgaattaaggtcctttcgtcatgcaaatttggggaacatcaaagagacaaagactagggaccactatttcttacagttcccctcatggtctgagaatatgctggga

SEQ ID NO: 8313 - DNA, 316 bp, Artificial
  TaSBEIIa allele with mutations introduced by TALEN pair TaSBEIIa_T02
tcagatggatgtgcattctagcaagaacttcacaacataatgcaccgtttggggtttcgtcagtctgctctacaattgctattttcgtgctgtagatagttgtcccaaaaccaggagatgggcagaaaatatacgagattgacccaacactgaaagattttcggagccatcttgactaccggtaatgcctacccgctgctttcgctcattttgaattaaggtcctttcatcatgcaaatttggggaacatcaaagagacaaagactagggaccaccatttcatacagatcccctgtggtctgagaatatgctggga

SEQ ID NO: 8314 - DNA, 417 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaaccaaaggagttaaggaactagtcgtgggggagaaaccgcgagttgtcccaaaaccaggagatgggcagaaaatatacgagattgacccaacgctgaaagattttcggagccatcttgactaccggtaatgcctaccgctactttcgctcattttgaattaaggtcctttcgtcatgcaaatttggggaacatcaaagagacaaagactagggaccactatttcttacagttcccctcatggtctgagaatatgctggga

SEQ ID NO: 8315 - DNA, 462 bp, Artificial; identical to SEQ ID NO: 7766
  TaSBEIIa allele with mutations introduced by TALEN pair TaSBEIIa_T02

SEQ ID NO: 8316 - DNA, 412 bp, Artificial; identical to SEQ ID NO: 7761
  TaSBEIIa allele with mutations introduced by TALEN pair TaSBEIIa_T02

SEQ ID NO: 8317 - DNA, 466 bp, Artificial; identical to SEQ ID NO: 7985
  TaSBEIIa allele with mutations introduced by TALEN pair TaSBEIIa_T02

SEQ ID NO: 8318 - DNA, 359 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttgggaacatcaaagagacaaaagactagggaccactaatttcttaacagttcccctcatggtctgagaatatgctggga

SEQ ID NO: 8319 - DNA, 440 bp, Artificial
  TaSBEIIa allele with mutations introduced by TALEN pair TaSBEIIa_T02
  misc_feature (236): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcactgatggtgtaaccaaaggagttaaggaactagtcgtgggggagaaaccgcgagttgtcccaaaaaccnggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8320 - DNA, 424 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcaaaggagttaaggaactagtcgtgggggagaaaccgcgagttgtcccaaaaaccaggagatgggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttctacagttccctcatggtctgagaatatgctggga

SEQ ID NO: 8321 - DNA, 452 bp, Artificial
  TaSBEIIa allele with mutations introduced by TALEN pair TaSBEIIa_T02
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcgatggtgtaaccaaaggagttaaggaactagtcgtgggggagaaaccgcgagttgtcccaaaaccaggagatgggcagaaaatatacgagattgacccaacactgaaagattttcggagccatcttgactaccggtaatgcctacccgctgctttcgctcattttgaattaaggtcctttcatcatgcaaatttgggaacatcaaagagacaaagactaggaccaccattcatacagatccctcgtggtctgagaatatgctggga

SEQ ID NO: 8322 - DNA, 467 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcatcaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatacaaagagacaaagactagggaccactatttcttactagttcccctcatggtctgagaatatgctggga

SEQ ID NO: 8323 - DNA, 419 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8324 - DNA, 461 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcggaaacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtccttcgtcatgcaaatttggggaacatcaaagagacaaagactagggaccactattcttacagttcccctcatggtctgagaatatgctggga

SEQ ID NO: 8325 - DNA, 415 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactaggaccactattcttacagttcccctcatggtctgagaatatgctggga

SEQ ID NO: 8326 - DNA, 346 bp, Artificial; identical to SEQ ID NO: 7742
  TaSBEIIa allele with mutations introduced by TALEN pair TaSBEIIa_T02

SEQ ID NO: 8327 - DNA, 386 bp, Artificial; identical to SEQ ID NO: 8210
  TaSBEIIa allele with mutations introduced by TALEN pair TaSBEIIa_T02
  misc_feature (364): n is a or c or t or g

SEQ ID NO: 8328 - DNA, 409 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatctagtcgtgggggagaaaccgcgagttgtcccaaaaccaggagatgggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8329 - DNA, 456 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctaccgctactttcgctcattttgaattaaggtcctttcgtcatgcaaatttggggaacatcaaagagacaaagactagggaccactatttcttacagttcccctcatggtctgagatatgctggga

SEQ ID NO: 8330 - DNA, 439 bp, Artificial; identical to SEQ ID NO: 7917
  TaSBEIIa allele with mutations introduced by TALEN pair TaSBEIIa_T02

SEQ ID NO: 8331 - DNA, 376 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtgaactagtcgtgggggagaaaccgcgagttgtcccaaaaccaggagatgggcagaaaatatacgagattgacccaacactgaaagattttcggagccatcttgactaccggtaatgcctacccgctgctttcgctcattttgaattaaggtcctttcatcatgcaaatttggggaacatcaaagagacaaagactagggaccaccatttcatacagactccctcgtggtctgagaatatgctggga

SEQ ID NO: 8332 - DNA, 367 bp, Artificial; identical to SEQ ID NO: 7647
  TaSBEIIa allele with mutations introduced by TALEN pair TaSBEIIa_T02

SEQ ID NO: 8333 - DNA, 448 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggtaaccaaaggagttaaggaactagtcgtgggggagaaaccgcgagttgtacccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8334 - DNA, 433 bp, Artificial; identical to SEQ ID NO: 7876
  TaSBEIIa allele with mutations introduced by TALEN pair TaSBEIIa_T02

SEQ ID NO: 8335 - DNA, 456 bp, Artificial
  TaSBEIIa allele with mutations introduced by TALEN pair TaSBEIIa_T02
  misc_feature (229): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcactgatggtgtaaccaaggagttaaggaactagtcgtggggganaaaccgcgagttgtcccaaaaccaggagatgggcagaaaatatacgagattgacccaacgctgaaagattttcggagccatcttgactaccggtaatgcctaccgctactttcgctcattttgaattaaggtcctttcgtcatgcaaatttggggaacatcaaagagacaaagactagggaccactatttcttacagttcccctcactggtctgagatatgctggga

SEQ ID NO: 8336 - DNA, 432 bp, Artificial; identical to SEQ ID NO: 7923
  TaSBEIIa allele with mutations introduced by TALEN pair TaSBEIIa_T02

SEQ ID NO: 8337 - DNA, 433 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccaaaggagttaaggaactagtcgtgggggagaaaccgcgagttgtcccaaaaccaggagatgggcaagaaaatatacgagattgacccaacgctgaaagattttcggagccatcttgactaccggtaatgcctacccgctactttcgctcattttgaattaaggtcctttcgtcatgcaaatttgggaacatcaaagagacaaagactagggaccactatttcttacagttcccctcatggtctgagaatatgctggga

SEQ ID NO: 8338 - DNA, 456 bp, Artificial
  TaSBEIIa allele with mutations introduced by TALEN pair TaSBEIIa_T02
  misc_feature (226): n is a or c or t or g
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcactgatggtgtaaccaaaggagttaaggaactagtcgtggggganaaaccgcgagttgtcccaaaaccaggagatgggcagaaaatatacgagattgacccaacactgaaagattttcggagccatcttgactaccggtaatgcctacccgctgctttcgctcattttgaattaaggtcctttcatcatgcaaatttggggaacatcaaagagaacaaagactagggaccaccatttcatacagactcccctcgtggtctgagaatatgctggga

SEQ ID NO: 8339 - DNA, 452 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcactgatggtgtaaccaaaggagttaaggaactagtcgtgggggagaaaccgcgagttgtcccaaaaccaggagatgggcagaaaatatacgagattgacccaacgctgaaagatttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8340 - DNA, 422 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagatatgctggga

SEQ ID NO: 8341 - DNA, 471 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgacaatcactgatggtgtaaccaaaggagttaaggaactagtcgcgggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 8342 - DNA, 414 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatctgaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtccttttcgtcatgcaaatttggggaacatcaaagagacaaagactagggaccactatttcttacagttcccctcatggtctgagaatatgctggga

SEQ ID NO: 8343 - DNA, 464 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcaatcactgatggtgtaaccaaaggagttaaggaactagtcgcgggggagaaaccgcgagttgtcccaaaaccaggagatgggcagaaaatatacgagattgacccaacgctgaaagattttcggagccatcttgactaccggtaatgcctacccgctaatttcgctcatttgaattaaggtcctttcatcatgcaaatttggggaacatcaaagaggcaaagactagggaccactatttcatacagttcccctcatggtctgagaatatgctggga

SEQ ID NO: 8344 - DNA, 465 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgcaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctaccgctactttcgctcattttgaattaaggtcctttcgtcatgcaaatttggggaacatcaaagagacaaagactagggaccactatttcttacagttcccctcatggtctgagatatgctggga

SEQ ID NO: 8345 - DNA, 450 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattcttacagttccctcatggtctgagaatatgctggga

SEQ ID NO: 8346 - DNA, 453 bp, Artificial; identical to SEQ ID NO: 7997
  TaSBEIIa allele with mutations introduced by TALEN pair TaSBEIIa_T02

SEQ ID NO: 8347 - DNA, 454 bp, Artificial
  TaSBEIIa allele with mutations introduced by TALEN pair TaSBEIIa_T02
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcactgatggtgtaaccaaaggagttaaggaactagtcgtgggggagaaaccgcgagttgtcccaaaaaccaggagatgggcagaaaatatacgagattgacccaacactgaaagattttcggagccatcttgactaccggtaatgcctaccgctgctttcgctcattttgaattaaggtcctttcatcatgcaaatttggggaacatcaaagagacaaagactagggaccaccatttcatacagatcccctcgtggtctgagaatatgctggga

SEQ ID NO: 8348 - DNA, 367 bp, Artificial; identical to SEQ ID NO: 7647
  TaSBEIIa allele with mutations introduced by TALEN pair TaSBEIIa_T02

SEQ ID NO: 8349 - DNA, 456 bp, Artificial
  TaSBEIIa allele with mutations introduced by TALEN pair TaSBEIIa_T02
  misc_feature (251): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattggtgtaaccaaaggagttaaggaactagtcgtgggggagaaaccgcgagttgtcccaaaaccnggagatgggcagaaaatatacgagattgacccaacgctgaaagattttcggagccatcttgactaccggtaatgcctacccgctactttcgctcattttgaattaaggtcctttcgtcatgcaaattttggggaacatcaaagagacaaagactagggaccactatttcttacagttcccctcatggtctgagaatatgctggga

SEQ ID NO: 8350 - DNA, 457 bp, Artificial
  TaSBEIIa allele with mutations introduced by TALEN pair TaSBEIIa_T02
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcgatggtgtaaccaaaggagttaaggaactagtcgtgggggagaaaccgcgagttgtcccaaaaaccaggagatgggcagaaaatatacgagattgacccaacactgaaagattttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 8351 - DNA, 417 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttccctcatggtctgagaatatgctggga

SEQ ID NO: 8352 - DNA, 450 bp, Artificial
  TaSBEIIa allele with mutations introduced by TALEN pair TaSBEIIa_T02
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgaccaaaggagttaaggaactagtcgtgggggagaaaccgcgagttgtcccaaaaaccaggagatgggcagaaaatatacgagattgacccaacactgaaagattttcggagccatcttgactaccggtaatgcctacccgctgctttcgctcattttgaattaaggtcctttcatcatgcaaatttggggaacatcaaagagacaaagactagggaccacatttcatacagatccctcgtggtctgagaatatgctggga

SEQ ID NO: 8353 - DNA, 457 bp, Artificial; identical to SEQ ID NO: 8062
  TaSBEIIa allele with mutations introduced by TALEN pair TaSBEIIa_T02

SEQ ID NO: 8354 - DNA, 357 bp, Artificial; identical to SEQ ID NO: 7752
  TaSBEIIa allele with mutations introduced by TALEN pair TaSBEIIa_T02

SEQ ID NO: 8355 - DNA, 326 bp, Artificial; identical to SEQ ID NO: 7855
  TaSBEIIa allele with mutations introduced by TALEN pair TaSBEIIa_T02

SEQ ID NO: 8356 - DNA, 456 bp, Artificial; identical to SEQ ID NO: 8071
  TaSBEIIa allele with mutations introduced by TALEN pair TaSBEIIa_T02

SEQ ID NO: 8357 - DNA, 391 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtcttgagaatatgctggga

SEQ ID NO: 8358 - DNA, 460 bp, Artificial
  TaSBEIIa allele with mutations introduced by TALEN pair TaSBEIIa_T02
  misc_feature (233); (302): n is a or c or t or g
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcactgatggtgtaaccaaaggagttaaggaactagtcgcggggganaaaccgcgagttgtcccaaaaccaggagatgggcagaaaatatacgagattgacccaacgctgaaaagnttttcggagccatcttgactaccggtaatgcctacccgctaatttcgctcattttgaatttaaggcctttcatcatgcaaatttgggaacatcaaagagcaaagactagggaccactatttcatacagttcccctcatggtctgagaatatgctggga

SEQ ID NO: 8359 - DNA, 387 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaaaccgcgagttgtcccaaaaccaggagatgggcagaaaatatacgagattgacccaacgctgaaagattttcggagccatcttgactaccggtaatgcctacccgctactttcgctcattttgaattaaggtccttcgtcatgcaaatttggggaacatcaaagagacaaagactagggaccactatttcttacagttccctcatggtctgagatatgctggga

SEQ ID NO: 8360 - DNA, 381 bp, Artificial; identical to SEQ ID NO: 7926
  TaSBEIIa allele with mutations introduced by TALEN pair TaSBEIIa_T02

SEQ ID NO: 8361 - DNA, 389 bp, Artificial; identical to SEQ ID NO: 7681
  TaSBEIIa allele with mutations introduced by TALEN pair TaSBEIIa_T02

SEQ ID NO: 8362 - DNA, 415 bp, Artificial
  TaSBEIIa allele with mutations introduced by TALEN pair TaSBEIIa_T02
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccagtcgtgggggagaaaccgcgagttgtcccaaaaccaggagatgggcagaaaatatacgagattgacccaacactgaaagattttcggagccatcttgactaccggtaatgcctacccgctgctttcgctcattttgattaaggtcctttcatcatgcaaatttggggaacatcaaagagacaaagactagggaccaccatttcatacagatcccctcgtggtctgagatatgctggga

SEQ ID NO: 8363 - DNA, 354 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaattgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttgggaacatcaaagaggcaaagactagggaccactatttcaatacagttcccctcatggtctgagaatatgctggga

SEQ ID NO: 8364 - DNA, 406 bp, Artificial; identical to SEQ ID NO: 8260
  TaSBEIIa allele with mutations introduced by TALEN pair TaSBEIIa_T02

SEQ ID NO: 8365 - DNA, 429 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtccttttcgtcatgcaaatttggggaacatcaaagagacaaagactagggaccatatttcttacagttcccctcatggtctgagaatatgctggga

SEQ ID NO: 8366 - DNA, 406 bp, Artificial; identical to SEQ ID NO: 8260
  TaSBEIIa allele with mutations introduced by TALEN pair TaSBEIIa_T02

SEQ ID NO: 8367 - DNA, 401 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgttatgcaaatttggggaacatcaaagagacaaagactagggaccactatttcttacagttcccctcatggtctgagaatatgctggga

SEQ ID NO: 8368 - DNA, 344 bp, Artificial; identical to SEQ ID NO: 7666
  TaSBEIIa allele with mutations introduced by TALEN pair TaSBEIIa_T02

SEQ ID NO: 8369 - DNA, 430 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcaccaaaggagttaaggaactagtcgtgggggagaaaccgcgagttgtcccaaaaaccaggagatgggcagaaaatatacgagattgacccaacactgaaagattttcggagccatcttgactaccggtaatgcctacccgctgctttcgctcattttgaattaaggtcctttcatcatgcaaatttggggaacatcaaaagagacaaagactagggaccaccattcatacagatccctcgtggtctgagaatatgctggga

SEQ ID NO: 8370 - DNA, 464 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaagggaacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtccttcgtcatgcaaatttggggaacatcaaagagacaaagactagggaccactatttcttacagttcccctcatggtctgagaatatgctggga

SEQ ID NO: 8371 - DNA, 453 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcggtgtaaccaaaggagttaaggaactagtcgtgggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaattttggggaacatcaaagagacaagactagggaccactatttcttacagttcccctcatggtctgagaatatgctgaga

SEQ ID NO: 8372 - DNA, 344 bp, Artificial; identical to SEQ ID NO: 7653
  TaSBEIIa allele with mutations introduced by TALEN pair TaSBEIIa_T02

SEQ ID NO: 8373 - DNA, 466 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgcaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcatttgaattaaggtcctttcgtcatgcaaatttggggaacatcaaagagacaaagactagggaccactatttcttacagttcccctcatggtctgagaatatgctggga

SEQ ID NO: 8374 - DNA, 418 bp, Artificial
  TaSBEIIa allele with mutations introduced by TALEN pair TaSBEIIa_T02
  misc_feature (358): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagngacaagactagggaccactatttcttacagttcccctcatggtctgagaatatgctggga

SEQ ID NO: 8375 - DNA, 460 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactaggaccactattcttacagttcccctcatggtctgagaatatgctggga

SEQ ID NO: 8376 - DNA, 375 bp, Artificial; identical to SEQ ID NO: 7739
  TaSBEIIa allele with mutations introduced by TALEN pair TaSBEIIa_T02

SEQ ID NO: 8377 - DNA, 460 bp, Artificial; identical to SEQ ID NO: 7770
  TaSBEIIa allele with mutations introduced by TALEN pair TaSBEIIa_T02

SEQ ID NO: 8378 - DNA, 344 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactaggaccactatttctacagttcccctcatggtctgagaatatgctggga

SEQ ID NO: 8379 - DNA, 409 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcaaaggagttaaggaactagtcgtgggggagaaaccgcgagttgtcccaaaaccaggagatgggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattcttacagttcccctcatggtctgagaatatgctggga

SEQ ID NO: 8380 - DNA, 420 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactagtcgtgggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattcttacagttcccctcatggtctgagaatatgctggga

SEQ ID NO: 8381 - DNA, 456 bp, Artificial; identical to SEQ ID NO: 8004
  TaSBEIIa allele with mutations introduced by TALEN pair TaSBEIIa_T02

SEQ ID NO: 8382 - DNA, 446 bp, Artificial
  TaSBEIIa allele with mutations introduced by TALEN pair TaSBEIIa_T02
  misc_feature (219); (242): n is a or c or t or g
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagactgatggtgtaaccaaaggagttaaggaactagtcgcggggganaaaccgcgagttgcccaaaaccnggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccacgtatttcatacagttcccctcatggtctgagaatatgctgga

SEQ ID NO: 8383 - DNA, 457 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattcttacagttcccctcatggtctgagaatatgctggga

SEQ ID NO: 8384 - DNA, 386 bp, Artificial; identical to SEQ ID NO: 7993
  TaSBEIIa allele with mutations introduced by TALEN pair TaSBEIIa_T02

SEQ ID NO: 8385 - DNA, 473 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgacaatcactgatggtgtaaccaaaggagttaaggaactagtcgcgggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatacaaagaggacaaagactagggaccactatttcatacagttcccctcatggtctgagaatatgctggga

SEQ ID NO: 8386 - DNA, 452 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8387 - DNA, 344 bp, Artificial; identical to SEQ ID NO: 7666
  TaSBEIIa allele with mutations introduced by TALEN pair TaSBEIIa_T02

SEQ ID NO: 8388 - DNA, 462 bp, Artificial; identical to SEQ ID NO: 7766
  TaSBEIIa allele with mutations introduced by TALEN pair TaSBEIIa_T02

SEQ ID NO: 8389 - DNA, 454 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaattttggggaacatcaaagagacaaagactagggaccactatttcttacagttcccctcatggtctgagaatatgctggga

SEQ ID NO: 8390 - DNA, 437 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaaggagttaaggaactagtcgtgggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttctacagttccctcatggtctgagaatatgctggga

SEQ ID NO: 8391 - DNA, 435 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggagttaaggaactagtcgtgggggagaaaccgcgagttgtcccaaaaccaggagatgggcagaaaatatacgagattgacccaacgctgaaagatttcggagccatcttgactaccggtaatgcctacccgctactttcgctcattttgaattaaggtcctttcgtcatgcaaatttggggaacatcaaagagacaaagactagggaccactattcttacagttcccctcatggtctgagaatatgctggga

SEQ ID NO: 8392 - DNA, 449 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcactgatggtgtaaccaaaggagttaaggaactagtcgtgggggagaaaccgcgagttgtcccaaaaaccaggagatgggcagaaaatatacgagattgacccaacgctgaaagatttcggagccatcttgactaccggtaatgcctaccgctactttcgctcattttgaattaaggtcctttcgtcatgcaaatttggggaacatcaaagagacaaagactagggaccactatttcttacagttccctcatggtctgagatatgctgga

SEQ ID NO: 8393 - DNA, 463 bp, Artificial; identical to SEQ ID NO: 8132
  TaSBEIIa allele with mutations introduced by TALEN pair TaSBEIIa_T02

SEQ ID NO: 8394 - DNA, 453 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgcttcattttgaattaaggtccttttcgtcatgcaaattttggggaaacatcaaagagacaaagactagggaccactatttcttacagttcccctcatggtctgagaatatgctggga

SEQ ID NO: 8395 - DNA, 457 bp, Artificial; identical to SEQ ID NO: 7837
  TaSBEIIa allele with mutations introduced by TALEN pair TaSBEIIa_T02
  misc_feature (230): n is a or c or t or g

SEQ ID NO: 8396 - DNA, 376 bp, Artificial; identical to SEQ ID NO: 7693
  TaSBEIIa allele with mutations introduced by TALEN pair TaSBEIIa_T02

SEQ ID NO: 8397 - DNA, 452 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcactgatggtgtaaccaaaggagttaaggaactagtcgtgggggagaaaccgcgagttgtcccaaaaaccaggagatgggcagaaaatatacgagattgacccaacgctgaaagatttcggagccatcttgactaccggtaatgcctaccgctactttcgctcattttgaattaaggtcctttcgtcatgcaaatttggggaacatcaaagagacaaagactagggaccactatttcttacagttcccctcatggtctgagaatatgctggga

SEQ ID NO: 8398 - DNA, 460 bp, Artificial; identical to SEQ ID NO: 7770
  TaSBEIIa allele with mutations introduced by TALEN pair TaSBEIIa_T02

SEQ ID NO: 8399 - DNA, 467 bp, Artificial; identical to SEQ ID NO: 8006
  TaSBEIIa allele with mutations introduced by TALEN pair TaSBEIIa_T02

SEQ ID NO: 8400 - DNA, 367 bp, Artificial; identical to SEQ ID NO: 7647
  TaSBEIIa allele with mutations introduced by TALEN pair TaSBEIIa_T02

SEQ ID NO: 8401 - DNA, 465 bp, Artificial; identical to SEQ ID NO: 7339
  TaSBEIIa allele with mutations introduced by TALEN pair TaSBEIIa_T02

SEQ ID NO: 8402 - DNA, 467 bp, Artificial; identical to SEQ ID NO: 8006
  TaSBEIIa allele with mutations introduced by TALEN pair TaSBEIIa_T02

SEQ ID NO: 8403 - DNA, 435 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttctacagttcccctcatggtctgagaatatgctggga

SEQ ID NO: 8404 - DNA, 408 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaattagtcgtgggggagaaaccgcgagttgtcccaaaaaccaggagatgggcagaaaatatacgagattgacccaacgctgaaagattttcggagccatcttgactaccggtaatgcctaccgctactttcgctcattttgaattaaggtcctttcgtcatgcaaattttggggaacatcaaagagacaaagactagggaccactatttcttacagttccccctcatggtctgagaatatgctgga

SEQ ID NO: 8405 - DNA, 454 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8406 - DNA, 417 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaaaccaaaggagttaaggaactagtcgtgggggagaaaccgcgagttgtcccaaaaccaggagatgggcagaaaatatacgagattgacccaacgctgaaagattttcggagccatcttgactaccggtaatgcctaccgctactttcgctcattttgaattaaggtcctttcgtcatgcaaatttggggaacatcaaagagacaaagactagggaccactattcttacagttcccctcatggtctgagaatatgctggga

SEQ ID NO: 8407 - DNA, 439 bp, Artificial; identical to SEQ ID NO: 7917
  TaSBEIIa allele with mutations introduced by TALEN pair TaSBEIIa_T02

SEQ ID NO: 8408 - DNA, 440 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggagttaaggaactagtcgtggggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacacgttcccctcatggtctgagaatatgctggga

SEQ ID NO: 8409 - DNA, 346 bp, Artificial; identical to SEQ ID NO: 7742
  TaSBEIIa allele with mutations introduced by TALEN pair TaSBEIIa_T02

SEQ ID NO: 8410 - DNA, 462 bp, Artificial; identical to SEQ ID NO: 7766
  TaSBEIIa allele with mutations introduced by TALEN pair TaSBEIIa_T02

SEQ ID NO: 8411 - DNA, 465 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcaggacaatcactgatggtgtaaccaaaggagttaaggaactagtcgcgggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 8412 - DNA, 346 bp, Artificial; identical to SEQ ID NO: 7742
  TaSBEIIa allele with mutations introduced by TALEN pair TaSBEIIa_T02

SEQ ID NO: 8413 - DNA, 420 bp, Artificial
  TaSBEIIa allele with mutations introduced by TALEN pair TaSBEIIa_T02
  misc_feature (217): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactagtcgtgggggagaaaccgcgagttgtcccaaaaaccnggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggctgagaatatgctggga

SEQ ID NO: 8414 - DNA, 345 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaatatacgagattgacccaacgctgaaagattttcggagccatcttgactaccggtaatgcctacccgctactttcgctcatttgaattaaggtcctttcgtcatgcaaatttggggaacatcaaagagacaaagactagggaccactatttcttacagttcccctcatggtctgagaatatgctggga

SEQ ID NO: 8415 - DNA, 406 bp, Artificial; identical to SEQ ID NO: 8260
  TaSBEIIa allele with mutations introduced by TALEN pair TaSBEIIa_T02

SEQ ID NO: 8416 - DNA, 425 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttgggaacatcaaagagacaaagactagggaccactattctacagttccctcatggtctgagaatatgctggga

SEQ ID NO: 8417 - DNA, 459 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgagacatcgaggagcaaacggctgaagtaaacatgacaggggggactgcagaaaaacttgaatcttcagaaccgactcaaggcaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcatttgaattaaggtcctttcgtcatgcaaatttggggaacatcaaagagacaaagactagggaccactatttcttacagttcccctcatggtctgagatatgctggga

SEQ ID NO: 8418 - DNA, 389 bp, Artificial; identical to SEQ ID NO: 7857
  TaSBEIIa allele with mutations introduced by TALEN pair TaSBEIIa_T02

SEQ ID NO: 8419 - DNA, 382 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttgtcccaaaaccaggagatgggcagaaatatacgagattgacccaacgctgaaagatttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8420 - DNA, 456 bp, Artificial
  TaSBEIIa allele with mutations introduced by TALEN pair TaSBEIIa_T02
  misc_feature (229): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaatcactgatggtgtaaccaaaggagttaaggaactagtcgtggggganaaaccgcgagttgtcccaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactaggggaccactatttcttacagttccctcatggtctgagaatatgctggga

SEQ ID NO: 8421 - DNA, 457 bp, Artificial; identical to SEQ ID NO: 8168
  TaSBEIIa allele with mutations introduced by TALEN pair TaSBEIIa_T02

SEQ ID NO: 8422 - DNA, 342 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagaaaccgcgagttgtcccaaaaccaggagatgggcagaaaatatacgagattgacccaacgctgaaagattttcggagccatcttgactaccggtaatgcctacccgctactttcgctcatttgaattaaggtcctttcgtcatgcaaatttggggaacatcaaagagacaaagactagggaccactattcttacagttcccctcatggtctgagaatatgctggga

SEQ ID NO: 8423 - DNA, 456 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctaccgctactttcgctcattttgaattaaggtcctttcgtcatgcaaattggggaacatcaaagagacaaagactagggaccactatttcttacagttcccctacatggtctgagaatatgctggga

SEQ ID NO: 8424 - DNA, 461 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctacttcgctcattttgaattaaggtcctttcgtcatgcaaatttgggaacatcaaagagacaaagactagggaccactatttcttacacgttcccctcatggtctgagaatatgctggga

SEQ ID NO: 8425 - DNA, 455 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctaccgctactttcgctcattttgaattaaggtcctttcgtcatgcaaatttggggaacatcaaagagacaaagactagggaccactattcttacagttccctcatggtctgagaatatgctggga

SEQ ID NO: 8426 - DNA, 381 bp, Artificial
  TaSBEIIa allele with mutations introduced by TALEN pair TaSBEIIa_T02
  misc_feature (320): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagngacaaagactagggaccactatttcttacagttcccctcatggtctgagaatatgctggga

SEQ ID NO: 8427 - DNA, 454 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttccctcatggtctgagaatatgctggga

SEQ ID NO: 8428 - DNA, 456 bp, Artificial
  TaSBEIIa allele with mutations introduced by TALEN pair TaSBEIIa_T02
  misc_feature (230): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcactgatggtgtaaccaaaggagttaaggaactagtcgtggggganaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttgggaacatcaaagagacaaagactagggaccactattcttacagttcccctcatggtctgagaatatgctggga

SEQ ID NO: 8429 - DNA, 465 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattcttacagttcccctcatggtctgagaatatgctggga

SEQ ID NO: 8430 - DNA, 418 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttaaggaactagtcgtgggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8431 - DNA, 202 bp, Artificial
  TaSBEIIa allele with mutations introduced by TALEN pair TaSBEIIa_T02
tcagatggatgtgacattctagcaagaacttcacgaaatggattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8432 - DNA, 452 bp, Artificial; identical to SEQ ID NO: 7854
  TaSBEIIa allele with mutations introduced by TALEN pair TaSBEIIa_T02

SEQ ID NO: 8433 - DNA, 442 bp, Artificial
  TaSBEIIa allele with mutations introduced by TALEN pair TaSBEIIa_T02
tcagatggatgtgcagttctagcaaagaacttcacgaaataatgcactgtttggtggtttcgttagtctgctctacaattgctattttcgtgctgtagatacctgaagacatcgaggagcaaacggctgaagtaaacatgacaggggggactgcagaaaaacttgaatcttcagaaccgactcaaaggagttaaggaactagtcgtgggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8434 - DNA, 449 bp, Artificial
  TaSBEIIa allele with mutations introduced by TALEN pair TaSBEIIa_T02
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgaccaaaggagttaaggaactagtcgtgggggagaaaccgcgagttgtcccaaaaaccaggagatgggcagaaaatatacgagattgacccaacactgaaagattttcggagccatcttgactaccggtaatgcctacccgctgctttcgctcattttgaattaaggtcctttcatcatgcaaatttggggaacatcaaagagacaaagactagggaccaccattcatacagatccctcgtggtctgagaatatgctgga

SEQ ID NO: 8435 - DNA, 419 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaattttggggaacatcaaagagacaaagactagggaccactatttcttacagttcccctcatggtctgagaatatgctggga

SEQ ID NO: 8436 - DNA, 461 bp, Artificial
  TaSBEIIa allele with mutations introduced by TALEN pair TaSBEIIa_T02
tcagatggatgtgcattactagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaatttaaggtcctttcgtcatgcaaaatttggggaacatcaaagagacaaagactagggaccactatttcttacagttcccctcatggtctgagaatatgctggga

SEQ ID NO: 8437 - DNA, 450 bp, Artificial; identical to SEQ ID NO: 7954
  TaSBEIIa allele with mutations introduced by TALEN pair TaSBEIIa_T02

SEQ ID NO: 8438 - DNA, 431 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttggatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttccctcatggtctgagaatatgctggga

SEQ ID NO: 8439 - DNA, 434 bp, Artificial
  TaSBEIIa allele with mutations introduced by TALEN pair TaSBEIIa_T02
  misc_feature (234); (377): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggagttaaggaactagtcgtgggggagaaaccgcgagttgtcccaaaaaccnggagatgggcagaaaatatacgagattgacccaacgctgaaagattttcggagccatcttgactaccggtaatgcctacccgctactttcgctcattttgaattaaggtcctttcgtcatgcaaatttggggaacatcaaagngacaaagactagggaccactattcttacagttccctcatgtctgagatatgctggga

SEQ ID NO: 8440 - DNA, 451 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcggaaacaatcactgatggtgtaaccaaaggagttaaggaactagtcgtgggggagaaaccgcgagttgtcccaaaaccaggagatgggcagaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8441 - DNA, 452 bp, Artificial
  TaSBEIIa allele with mutations introduced by TALEN pair TaSBEIIa_T02
  misc_feature (224); (248): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgatcactgatggtgtaaccaaaggagttaaggaactagtcgtggggganaaaccgcgagttgtcccaaaaacnggagatggacagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8442 - DNA, 420 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactagtcgtgggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttccctcatggtctgagaatatgctggga

SEQ ID NO: 8443 - DNA, 461 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagatatgctggga

SEQ ID NO: 8444 - DNA, 456 bp, Artificial
  TaSBEIIa allele with mutations introduced by TALEN pair TaSBEIIa_T02
  misc_feature (230): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgatggtgtaaccaaaggagttaaggaactagtcgtggggganaaaccgcgagttgtcccaaaaccaggagatgggcagaaaatatacgagattgacccaacgctgaaagattttcggagccatcttgactaccggtaatgcctaccgctactttcgctcattttgaattaaggtcctttcgtcatgcaaatttggggaacatcaaagagacaaagactagggaccactattcttacagttcccctcatggtctgagaatatgctggga

SEQ ID NO: 8445 - DNA, 450 bp, Artificial
  TaSBEIIa allele with mutations introduced by TALEN pair TaSBEIIa_T02
  misc_feature (153); (221): n is a or c or t or g
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccncagagaaacttgaatcttcaatcactgatggtgtaaccaaaggagttaaggaactagtcgcggggganaaaccgcgagttgtcccaaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 8446 - DNA, 463 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaagggaacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattcttacagttcccctcatggtctgagatatgctggga

SEQ ID NO: 8447 - DNA, 449 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactatggtgtaaccaaaggagttaaggaactagtcgtgggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8448 - DNA, 450 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactgatggtgtaaccaaaggagttaaggaactagtcgtgggggagaaaccgcgagttgtacccaaaaccaggagatgggcagaaatatacgagattgacccaacgctgaaagattttcggagccatcttgactaccggtaatgcctacccgctactttcgctcattttgaattaaggtcctttcgtcatgcaaattttggggaacatcaaagagacaaagactagggaccactatttcttacagttcccctcatggtctgagaatatgctggga

SEQ ID NO: 8449 - DNA, 367 bp, Artificial; identical to SEQ ID NO: 7647
  TaSBEIIa allele with mutations introduced by TALEN pair TaSBEIIa_T02

SEQ ID NO: 8450 - DNA, 468 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgcaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcattgcaaatttggggaacatcaaagagacaaagactagggaccactatttcttacagttcccctcatggtctgagaatatgctggga

SEQ ID NO: 8451 - DNA, 466 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgcactgatggtgtaaccaaaggagttaaggaactagtcgcgggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 8452 - DNA, 455 bp, Artificial
  TaSBEIIa allele with mutations introduced by TALEN pair TaSBEIIa_T02
tcagatggatgtgcattactagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaacaatcactgatggtgtaaccaaaggagttaaggaactagtcgtgggggagaaaccgcgagttgtcccaaaaaccaggagatgggcagaaaatatacgagattgacccaacactgaaagattttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 8453 - DNA, 462 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcaatcactgatggtgcaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8454 - DNA, 463 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcggaaacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8455 - DNA, 457 bp, Artificial
  TaSBEIIa allele with mutations introduced by TALEN pair TaSBEIIa_T02
  misc_feature (230): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcactgatggtgtaaccaaaggagttaaggaactagtcgtggggganaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattcttacagttcccctcatggtctgagaatatgctggga

SEQ ID NO: 8456 - DNA, 457 bp, Artificial
  TaSBEIIa allele with mutations introduced by TALEN pair TaSBEIIa_T02
  misc_feature (450): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcatttgaattaaggtccttcgtcatgcaaatttgggaacatcaaagagacaaagactagggaccactattcttacagttccctcatggtctgagaatangctggga

SEQ ID NO: 8457 - DNA, 460 bp, Artificial
  TaSBEIIa allele with mutations introduced by TALEN pair TaSBEIIa_T02
  misc_feature (233): n is a or c or t or g
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcactgatggtgtaaccaaaggagttaaggaactagtcgcggggganaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttgggaacatcaaagaggcaaagactagggaccactatttcatacagttcccctcatggtctgagaatatgctggga

SEQ ID NO: 8458 - DNA, 433 bp, Artificial
  TaSBEIIa allele with mutations introduced by TALEN pair TaSBEIIa_T02
  misc_feature (248): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccaaaggagttaaggaactagtcgtgggggagaaaccgcgagttgtcccaaaaaccaggagatgggcagaaaatntacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttctacagttcccctcatggtctgagaatatgctggga

SEQ ID NO: 8459 - DNA, 452 bp, Artificial; identical to SEQ ID NO: 8386
  TaSBEIIa allele with mutations introduced by TALEN pair TaSBEIIa_T02

SEQ ID NO: 8460 - DNA, 375 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgtcgtgggggagaaaccgcgagttgtcccaaaaccaggagatgggcagaaaatatacgagattgacccaacgctgaaagattttcggagccatcttgactaccggtaatgcctacccgctactttcgctcatttgaattaaggtcctttcgtcatgcaaatttggggaacatcaaagagacaaagactagggaccactatttcttacagttcccctcatggtctgagaatatgctggga

SEQ ID NO: 8461 - DNA, 456 bp, Artificial
  TaSBEIIa allele with mutations introduced by TALEN pair TaSBEIIa_T02
  misc_feature (229): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaatcactgatggtgtaaccaaaggagttaaggaactagtcgtggggganaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattcttacagttcccctcatggtctgagaatatgctggga

SEQ ID NO: 8462 - DNA, 344 bp, Artificial; identical to SEQ ID NO: 7666
  TaSBEIIa allele with mutations introduced by TALEN pair TaSBEIIa_T02

SEQ ID NO: 8463 - DNA, 376 bp, Artificial; identical to SEQ ID NO: 7660
  TaSBEIIa allele with mutations introduced by TALEN pair TaSBEIIa_T02

SEQ ID NO: 8464 - DNA, 367 bp, Artificial; identical to SEQ ID NO: 7647
  TaSBEIIa allele with mutations introduced by TALEN pair TaSBEIIa_T02

SEQ ID NO: 8465 - DNA, 378 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttcccggggaaatcaaagagacaaagactagggaccactatttcttacagttcccctcatggtctgagaatatgctggga

SEQ ID NO: 8466 - DNA, 424 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattggggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8467 - DNA, 392 bp, Artificial; identical to SEQ ID NO: 7703
  TaSBEIIa allele with mutations introduced by TALEN pair TaSBEIIa_T02

SEQ ID NO: 8468 - DNA, 442 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatatctgaagacatcgaggagcaaacggctagaagtaaacatgacaggggggactgcagaaaaacttgaatcactgatggtgtaaccaaaggagttaaggaactagtcgtgggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaatttggggaaacatcaaagagacaaagactagggaccactatttcttacagttcccctcatggtctgagaatatgctggga

SEQ ID NO: 8469 - DNA, 200 bp, Artificial; identical to SEQ ID NO: 7622
  TaSBEIIa allele with mutations introduced by TALEN pair TaSBEIIa_T02

SEQ ID NO: 8470 - DNA, 423 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcaaaggagttaaggaactagtcgtgggggagaaaccgcgagttgtcccaaaaaccaggagatgggcagaaaatatacgagattgacccaacgctgaaagatttcggagccatcttgactaccggtaatgcctacccgctactttcgctcattttgaattaaggtcctttcgtcatgcaaatttggggaacatcaaagagacaaagactagggaccactattcttacagttcccctcatggtctgagaatatgctggga

SEQ ID NO: 8471 - DNA, 392 bp, Artificial
  TaSBEIIa allele with mutations introduced by TALEN pair TaSBEIIa_T02
  misc_feature (370): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctnatggtctgagaatatgctggga

SEQ ID NO: 8472 - DNA, 449 bp, Artificial
  TaSBEIIa allele with mutations introduced by TALEN pair TaSBEIIa_T02
tcagatggatgtgattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcggaaacaatcactgatggtgtaaccaaaggagttaaggaactagtcgtgggggagaaaccgcgagttgtcccaaaaacaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattcttacagttccctcatggtctgagaatatgctggga

SEQ ID NO: 8473 - DNA, 464 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgaatcactgatggtgtaaccaaaggagttaaggaactagtcgtgggggagaaaccgcgagttgtcccaaaaccaggagatgggcagaaaatatacgagattgacccaagctgaaagattttcggagccatcttgactaccggtaatgcctacccgctactttcgctcattttgaattaaggtcctttcgtcatgcaaatttggggaacatcaaagagacaaagactagggaccactatttcttacagttccctcatggtctgagaatatgctggga

SEQ ID NO: 8474 - DNA, 374 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtgaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttgggaacatcaaagagacaaagactagggaccactatttcttacagttccctcatggtctgagaatatgctggga

SEQ ID NO: 8475 - DNA, 409 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatctagtcgtgggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattcttacagttcccctcatggtctgagaatatgctgggga

SEQ ID NO: 8476 - DNA, 451 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcggaaacaatcactgatggtgtaaccaaaggagttaaggaactagtcgtgggggagaaaccgcgagttgtcccaaaaaccaggagatgggcagaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattcttacagttcccctcatggtctgagaatatgctggga

SEQ ID NO: 8477 - DNA, 452 bp, Artificial
  TaSBEIIa allele with mutations introduced by TALEN pair TaSBEIIa_T02
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaacaatcactgatggtgtaaccaaaggagttaaggaactagtcgtgggggagaaaccgcgagttgtcccaaaaccaggagatgggcagaaaatatacgagattgacccaacactgaaagattttcggagccatcttgactaccggtaatgcctacccgctgctttcgctcattttgaattaaggtcctttcatcatgcaaatttggggaacatcaaagagacaaagactagggaccaccatttcatacagatccctcgtggtctgagaatatgctggga

SEQ ID NO: 8478 - DNA, 382 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagatatgctggga

SEQ ID NO: 8479 - DNA, 446 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcataaccaaaggagttaaggaactagtcgtgggggagaaaccgcgagttgtcccaaaaccaggagatgggcagaaaatatacgagattgacccaacgctgaaagattttcggagccatcttgactaccggtaatgcctaccgctactttcgctcattttgaattaaggtcctttcgtcatgcaaatttggggaacatcaaagagacaaagactagggaccactatttctacagttccctcatggtctgagaatatgctggga

SEQ ID NO: 8480 - DNA, 453 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtgtaaccaaaggagttaaggaactagtcgtgggggagaaaccgcgagttgtcccaaaaaccaggagatgggcagaaaatatacgagattgacccaacgctgaaagatttcggagccatcttgactaccggtaatgcctacccgctaatttcgctcattttgaattaaggtcctttcatcatgcaaatttgggaacatcaaagaggcaaagactagggaccactatttcatacagttcccctcatggtctgagaatatgctggga

SEQ ID NO: 8481 - DNA, 451 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctaccgctactttcgctcattttgaattaaggtcctttcgtcatgcaaatttggggaacatcaaagagacaaagactagggaccactatttcttacagttcccctcatggtctgagaatatg

SEQ ID NO: 8482 - DNA, 462 bp, Artificial; identical to SEQ ID NO: 7766
  TaSBEIIa allele with mutations introduced by TALEN pair TaSBEIIa_T02

SEQ ID NO: 8483 - DNA, 424 bp, Artificial; identical to SEQ ID NO: 8466
  TaSBEIIa allele with mutations introduced by TALEN pair TaSBEIIa_T02

SEQ ID NO: 8484 - DNA, 417 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcatcatgcaaatttggggaacatcaaagagacaaagactagggaccaccatttcatacagatcccctcgtggtctgaaaatatgctggga

SEQ ID NO: 8485 - DNA, 454 bp, Artificial
  TaSBEIIa allele with mutations introduced by TALEN pair TaSBEIIa_T02
  misc_feature (228): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgaacaatcactgatggtgtaaccaaaggagttaaggaactagtcgtggggganaaaccgcgagttgtcccaaaaccaggagatgggcagaaaatatacgagattgacccaacgctgaaagattttcggagccatcttgactaccggtaatgcctaccgctactttcgctcattttgaattaaggtcctttcgtcatgcaaatttggggaacatcaaagagacaaagactagggaccactatttctacagttcccctcatggtctgagaatatgctggga

SEQ ID NO: 8486 - DNA, 367 bp, Artificial; identical to SEQ ID NO: 7647
  TaSBEIIa allele with mutations introduced by TALEN pair TaSBEIIa_T02

SEQ ID NO: 8487 - DNA, 453 bp, Artificial
  TaSBEIIa allele with mutations introduced by TALEN pair TaSBEIIa_T02
tcagatggatgtgcattactagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattggtgtaaccaaaggagttaaggaactagtcgtgggggagaaaccgcgagttgtcccaaaaaccaggagatgggcagaaaatatacgagattgacccaacgctgaaagatttcggagccatcttgactaccggtaatgcctaccgctactttcgctcattttgaattaaggtcctttcgtcatgcaaatttggggaacatcaaagagacaaagactagggaccactattcttacagttccctcatggtctgagaatatgctggga

SEQ ID NO: 8488 - DNA, 463 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctatccgctactttcgctcattttgaattaaggtccttttcgtcatgcaaatttggggaacatcaaagagacaaagactagggaccactatttcttacagttcccctcatggtctgagaatatgctggga

SEQ ID NO: 8489 - DNA, 438 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggagttaaggaactagtcgtgggggagaaaccgcgagttgtcccaaaaaccaggagatgggcagaaaatatacgagattgacccaacgctgaaagattttcggagccatcttgactaccggtaatgcctacccgctactttcgctcattttgaattaaggtccttttcgtcatgcaaatttggggaacatcaaagagacaaagactagggaccactatttctacagttcccctcatggtctgagaatatgctggga

SEQ ID NO: 8490 - DNA, 459 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgctaaattggggaacatcaaagagacaaagactagggaccactatttcttacagttcccctcactggtctgagaatatgctggga

SEQ ID NO: 8491 - DNA, 391 bp, Artificial
  TaSBEIIa allele with mutations introduced by TALEN pair TaSBEIIa_T02
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaaccgcgagttgtcccaaaaaccaggagatgggcagaaaatatacgagattgacccaacactgaaagattttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 8492 - DNA, 415 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtccttttcgtcatgcaaatttggggaacatcaaagagacaaagactaggaccactatttcttacagttcccctcatggtctgagaatatgctggga

SEQ ID NO: 8493 - DNA, 431 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcaccaaaggagttaaggaactagtcgtggggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8494 - DNA, 326 bp, Artificial; identical to SEQ ID NO: 7855
  TaSBEIIa allele with mutations introduced by TALEN pair TaSBEIIa_T02

SEQ ID NO: 8495 - DNA, 440 bp, Artificial
  TaSBEIIa allele with mutations introduced by TALEN pair TaSBEIIa_T02
tcagatggatgtgcattctagcaagaacttcacgaaataatgcgactgtttgtggtttcgttagtctgctctacaattgctattttcgtgctgtagatacctgaagacatcgaggagcaaacggctgaagtaaacatgacaggggggactgcagaaaaacaatcactgatggtgtaaccaaaggagttaaggaactagtcgtggggggagaaaccgcgagttgtcccaaaaaccaggagatgggcagaaaatatacgagattgacccaacgctgaaagattttcggagccatcttgactaccggtaatgcctacccgctactttcgctcattttgaattaaggtccttttcgtcatgcaaatttggggaacatcaaagagacaaagactagggaccactatttcttacagttcccctcatggtctgagaatatgctggga

SEQ ID NO: 8496 - DNA, 444 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcaatcactgatggtgtaaccaaaggagttaaggaactagtcgtgggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8497 - DNA, 454 bp, Artificial
  TaSBEIIa allele with mutations introduced by TALEN pair TaSBEIIa_T02
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaacaatcactgatggtgtaaccaaaggagttaaggaactagtcgtgggggagaaaccgcgagttgtcccaaaaaccaggagatgggcagaaaatatacgagattgacccaacactgaaagattttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 8498 - DNA, 432 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttggatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 8499 - DNA, 432 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttggatggtgtaaccaaaggagttaaggaactagtcgtgggggagaaaccgcgagttgtcccaaaaaccaggagatgggcagaaaatatacgagattgacccaacgctgaaaagattttcggagccatcttgactaccggtaatgcctaccgctactttcgctcattttgaattaaggtccttcgtcatgcaaatttggggaacatcaaagagacaaagactagggaccactatttcttacagttcccctcatggtctgagaatatgctggga

SEQ ID NO: 8500 - DNA, 446 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaactgatggtgtaaccaaaggagttaaggaactagtcgtgggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8501 - DNA, 445 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttgggaacatcaaagagacaaagactagggaccactatttcttacagttcccctcatggtctgagaatatgctggga

SEQ ID NO: 8502 - DNA, 376 bp, Artificial; identical to SEQ ID NO: 7693
  TaSBEIIa allele with mutations introduced by TALEN pair TaSBEIIa_T02

SEQ ID NO: 8503 - DNA, 458 bp, Artificial
  TaSBEIIa allele with mutations introduced by TALEN pair TaSBEIIa_T02
  misc_feature (433): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctaccgctactttcgctcattttgaattaaggtcctttcgtcatgcaaatttgggaacatcaaagagacaaagactagggaccactattcttacagttcccctnaccctggtctgagaatatgctggga

SEQ ID NO: 8504 - DNA, 455 bp, Artificial; identical to SEQ ID NO: 7941
  TaSBEIIa allele with mutations introduced by TALEN pair TaSBEIIa_T02

SEQ ID NO: 8505 - DNA, 383 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttctacagttcccctcatggtctgagaatatgctggga

SEQ ID NO: 8506 - DNA, 459 bp, Artificial
  TaSBEIIa allele with mutations introduced by TALEN pair TaSBEIIa_T02
  misc_feature (436): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcatttgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctaccgctactttcgctcattttgaattaaggtcctttcgtcatgcaaatttggggaacatcaaagagacaaagactagggaccactatttcttacagttcccctnactggtctgagaatatgctggga

SEQ ID NO: 8507 - DNA, 468 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattggctattttcgtgctgtagatacctgaagacatcgaggagcaaacggctgaagtaaacatgacaggggggactgcagaaaaacttgaatcttcagaaccgactcaaggcattgcaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8508 - DNA, 417 bp, Artificial; identical to SEQ ID NO: 8291
  TaSBEIIa allele with mutations introduced by TALEN pair TaSBEIIa_T02

SEQ ID NO: 8509 - DNA, 384 bp, Artificial; identical to SEQ ID NO: 7781
  TaSBEIIa allele with mutations introduced by TALEN pair TaSBEIIa_T02

SEQ ID NO: 8510 - DNA, 200 bp, Artificial; identical to SEQ ID NO: 7622
  TaSBEIIa allele with mutations introduced by TALEN pair TaSBEIIa_T02

SEQ ID NO: 8511 - DNA, 199 bp, Artificial; identical to SEQ ID NO: 7614
  TaSBEIIa allele with mutations introduced by TALEN pair TaSBEIIa_T02

SEQ ID NO: 8512 - DNA, 375 bp, Artificial
  TaSBEIIa allele with mutations introduced by TALEN pair TaSBEIIa_T02
  misc_feature (353): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttctacagttcccctnatggtctgagaatatgctggga

SEQ ID NO: 8513 - DNA, 457 bp, Artificial
  TaSBEIIa allele with mutations introduced by TALEN pair TaSBEIIa_T02
cagatggatgtgcattctagcaagaacttcacgaaataatgcactgtttgtggtttcgttagtctgctctacaattgctattttcgtgctgtagatacctgaagacatcgaggagcaaacggctgaagtaaaacatgacaggggggactgcagaaaaacttgaatcttcagaaccgactcacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcatttgaattaaggtcctttcgtcatgcaaatttggggaacatcaaagagacaaagactagggaccactattcttacagttcccctcatggtctgagaatatgctggga

SEQ ID NO: 8514 - DNA, 424 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcaaaggagttaaggaactagtcgtgggggagaaaccgcgagttgtcccaaaaccaggagatgggcagaaaatatacgagattgacccaacgctgaaagattttcggagccatcttgactaccggtaaatgcctacccgctactttcgctcattttgaattaaggtcctttcgtcatgcaaatttggggaacatcaaagagacaaagactagggaccactatttcttacagttccctcatggtctgagaatatgctggga

SEQ ID NO: 8515 - DNA, 425 bp, Artificial
  TaSBEIIa allele with mutations introduced by TALEN pair TaSBEIIa_T02
tcagatggatgtgcattactagcaagaacttcacaacataatggcaccgtttggggtttcgtcagtctgctctacaattgctatttttcgtgctgtagatacctgaagatatcgaggagcaaacggcggaagtgaacatgacaggggggactgcagagaaacttcaatcagttaaggaactagtcgtgggggagaaaccgcgagttgtcccaaaaaccaggagatgggcagaaaaatatacgagattgacccaacactgaaagattttcggagccatcttgactaccggtaatgcctacccgctgctttcgctcattttgaattaaggtccttttcatcatgcaaatttggggaacatcaaagagacaaagactagggaccaccatttcatacagatcccctcgtggtctgagaatatgctggga

SEQ ID NO: 8516 - DNA, 381 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaccgcgagttgtcccaaaaccaggagatgggcagaaaatatacgagattgacccaacgctgaaagattttcggagccatcttgactaccggtaatgcctacccgctactttcgctcatttgaattaaggtcctttcgtcatgcaaatttggggaacatcaaagagacaaaagactaaggaccactatttcttacagttcccctcatggtctgagaatatgctggga

SEQ ID NO: 8517 - DNA, 344 bp, Artificial; identical to SEQ ID NO: 7666
  TaSBEIIa allele with mutations introduced by TALEN pair TaSBEIIa_T02

SEQ ID NO: 8518 - DNA, 389 bp, Artificial
  TaSBEIIa allele with mutations introduced by TALEN pair TaSBEIIa_T02
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaaccgcgagttgtcccaaaaccaggagatgggcagaaaatatacgagattgacccaacactgaaagattttcggagccatcttgactaccggtaatgcctaccgctgctttcgctcattttgaattaaggtcctttcatcatgcaaatttggggaacatcaaagagacaaagactagggaccaccatttcatacagatcccctcgtggtctgagaatatgctggga

SEQ ID NO: 8519 - DNA, 419 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaaaccaaaggagttaaggaactagtcgtgggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttccctcatggtctgagaatatgctggga

SEQ ID NO: 8520 - DNA, 456 bp, Artificial; identical to SEQ ID NO: 8461
  TaSBEIIa allele with mutations introduced by TALEN pair TaSBEIIa_T02
  misc_feature (229): n is a or c or t or g

SEQ ID NO: 8521 - DNA, 449 bp, Artificial
  TaSBEIIa allele with mutations introduced by TALEN pair TaSBEIIa_T02
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgacaatcactgatggtgtaaccaaggagttaaggaactagtcgtgggggagaaaccgcgagttgtcccaaaaccaggagatgggcagaaaatatacgagattgacccaacactgaaagattttcggagccatcttgactaccggtaatgcctaccgctgctttcgctcattttgaattaggtcctttcatcatgcaaatttgggacatcaaagagacaagactagggaccaccatttcatacagatcccctgtggtctgagaatatgctggga

SEQ ID NO: 8522 - DNA, 449 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactgatggtgtaaccaaaggagttaaggaactagtcgtgggggagaaaccgcgagttgtcccaaaaaccaggagatgggcagaaaatatacgagattgacccaacgctgaaagatttcggagccatcttgactaccggtaatgcctacccgctactttcgctcattttgaattaaggtcctttcgtcatgcaaatttggggaacatcaaagagacaaagactagggaccactatttcatacagttcccctcatggtctgagaatatgctggga

SEQ ID NO: 8523 - DNA, 200 bp, Artificial; identical to SEQ ID NO: 7622
  TaSBEIIa allele with mutations introduced by TALEN pair TaSBEIIa_T02

SEQ ID NO: 8524 - DNA, 407 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaattagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttgggaacatcaaagagacaaagactagggaccactatttcttacagttcccctcatggtctgagaatatgctgggga

SEQ ID NO: 8525 - DNA, 445 bp, Artificial
  TaSBEIIa allele with mutations introduced by TALEN pair TaSBEIIa_T02
tcagatggatgtgcatctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8526 - DNA, 431 bp, Artificial
  TaSBEIIa allele with mutations introduced by TALEN pair TaSBEIIa_T02
  misc_feature (226); (245): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggaactagtcgtgggggagaaaccgcgagttgtcccaaaaaccnggagatgggcagaaaaatntacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8527 - DNA, 482 bp, Artificial
  TaSBEIIa allele with mutations introduced by TALEN pair TaSBEIIa_T02
  misc_feature (234); (470); (476): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcaatcactgatggtgtaaccaaaggagttaaggaactagtcgtggggganaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttgggaacatcaaagagaacaaagactagggaccactatttcttacagttcccctcatggtctgagaatatgctgggactgacagngccagngacacg

SEQ ID NO: 8528 - DNA, 382 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaccgcgagttgtcccaaaaccaggagatggggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8529 - DNA, 456 bp, Artificial; identical to SEQ ID NO: 8162
  TaSBEIIa allele with mutations introduced by TALEN pair TaSBEIIa_T02

SEQ ID NO: 8530 - DNA, 200 bp, Artificial; identical to SEQ ID NO: 7622
  TaSBEIIa allele with mutations introduced by TALEN pair TaSBEIIa_T02

SEQ ID NO: 8531 - DNA, 436 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaaggagttaaggaactagtcgtgggggagaaaccgcgagttgtcccaaaaaccaggagatgggcaagaaaatatacgagattgacccaacgctgaaagattttcggagccatcttgactaccggtaatgcctacccgctactttcgctcattttgaattaaggtcctttcgtcatgcaaatttggggaacatcaaagagacaagactagggaccactattcttacagttcccctcatgtctgagatatgctggga

SEQ ID NO: 8532 - DNA, 456 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggtgtaaccaaaggagttaaggaactagtcgtgggggagaaaccgcgagttgtcccaaaaaccaggagatgggcagaaaatatacgagattgacccaacgctgaaagattttcggagccatcttgactaccggtaatgcctaccgctactttcgctcattttgaattaaggtcctttcgtcatgcaaatttggggaacatcaaagagacaaagactagggaccactatttcttacagttccctcatggtctgagaatatgctggga

SEQ ID NO: 8533 - DNA, 458 bp, Artificial
  TaSBEIIa allele with mutations introduced by TALEN pair TaSBEIIa_T02
tcagatggagtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcactgagtggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaatttaaggtcctttcgtcatgcaaatttgggaacatcaaagagacaaagactagggaccactatttcttacagttcccctcatggtctgagaatatgctggga

SEQ ID NO: 8534 - DNA, 352 bp, Artificial
  TaSBEIIa allele with mutations introduced by TALEN pair TaSBEIIa_T02
tcagatggatgtgcattctagcaagaacttcacgaaactaatagcgactacgttttgggttcggttcgtagtctgctctacaattgctattttcgtgctgtagatacctgaagacatcgaggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8535 - DNA, 423 bp, Artificial
  TaSBEIIa allele with mutations introduced by TALEN pair TaSBEIIa_T02
  misc_feature (240): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattggggggagaaaccgcgagttgtcccaaaaaccaggagatgggcagaaaaatntacgagattgacccaacgctgaaagatttcggagccatcttgactaccggtaatgcctacccgctactttcgctcattttgaattaaggtcctttcgtcatgcaaatttggggaacatcaaagagacaaagactagggaccactatttcttacagttccctcatggtctgagatatgctggga

SEQ ID NO: 8536 - DNA, 466 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaagggaacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtccttttcgtcatgcaaatttggggaacatcaaagagacaaagactagggaccactatttcttacagttcccctcatggtctgagaatatgctggga

SEQ ID NO: 8537 - DNA, 413 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatctgaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8538 - DNA, 345 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttccctcatggtctgagaatatgctggga

SEQ ID NO: 8539 - DNA, 345 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagaaaccgcgagttcgtcccaaaaccaggagatgggcagaaaatatacgagattgacccaacgctgaaagattttcggagccatcttgactaccggtaatgcctacccgctactttcgctcattttgaattaaggtcctttcgtcatgcaatttggggaacatcaaagagacaaagactagggaccactatttcttacacgttcccctcatggtctgagaatatgctggga

SEQ ID NO: 8540 - DNA, 402 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagaaactagtcgcgggggagaaaccgcgagttgtcccaaaaaccaggagatgggcagaaaaatatacgagattgacccaacgctgaaagattttcggagccatcttgactaccggtaatgcctacccgctaatttcgctcattttgaattaaggtcctttcatcatgcaaatttgggaacatcaaagaggcaaagactagggaccactattcatacagttcccctcatggtctgagaatatgctggga

SEQ ID NO: 8541 - DNA, 441 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcactgatggtgtaaccaaaggagttaaggaactagtcgtgggggagaaaccgcgagttgtcccaaaaaccaggagatgggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8542 - DNA, 498 bp, Artificial
  TaSBEIIa allele with mutations introduced by TALEN pair TaSBEIIa_T02
  misc_feature (478): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcaaacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattcttacagttcccctcatggtctgagaatatctgggactgagatcccccgnaacggcacacaggggatagg

SEQ ID NO: 8543 - DNA, 457 bp, Artificial
  TaSBEIIa allele with mutations introduced by TALEN pair TaSBEIIa_T02
  misc_feature (230): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcactgatggtgtaaccaaaggagttaaggaactagtcgtggggganaaaaccgcgagttgtcccaaaaccaggagatgggcagaaaatatacgagattgacccaacgctgaaagattttcggagccatcttgactaccggtaatgcctaccgctactttcgctcattttgaattaaggtcctttcgtcatgcaaatttggggaacatcaaagagacaaagactagggaccactattcttacagttcccctcatggtctgagaatatgctggga

SEQ ID NO: 8544 - DNA, 409 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8545 - DNA, 462 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcactgatggtgtaaccaaaggagttaaggaactagtcgcgggggagaaaccgcgagttgtcccaaaaccaggagatgggcagaaaatatacgagattgacccaaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 8546 - DNA, 458 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaactatcaaagagacaaagactagggaccactatttcttacagttcccctcatggtctgagaatatgctggga

SEQ ID NO: 8547 - DNA, 411 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatctgaactagtcgtgggggagaaaccgcgagttgtcccaaaaaccaggagatgggcagaaaaatatacgagattgacccaacgctgaaagattttcggagccatcttgactaccggtaatgcctacccgctactttcgctcattttgaattaaggtccttcgtcatgcaaatttgggaacatcaaagagacaaagactagggaccactattcttacagttccctcatggtctgagaatatgctggga

SEQ ID NO: 8548 - DNA, 452 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcggaaacaatcactgatggtgtaaccaaaggagttaaggaactagtcgtgggggagaaaccgcgagttgtcccaaaaaccaggagatgggcagaaaatatacgagattgacccaacgctgaaaagattttcggagccattcttgactaaccggtaatgcctaccgctactttcgctcattttgaattaaggtcctttcgtcatgcaaatttgggaacatcaaagagacaaagactagggaccactattcttacagttccctcatggtctgagaatatgctggga

SEQ ID NO: 8549 - DNA, 465 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgcaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcatttgaattaaggtcctttcgtcatgcaaatttgggaacatcaaagagacaaagactagggaccactatttcttacagttcccctcatggtctgagaatatgctggga

SEQ ID NO: 8550 - DNA, 455 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattatggtgtaaccaaaggagttaaggaactagtcgtgggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaatttgggaacatcaaagagacaaagactagggaccactattcttacagttccctcatggtctgagaatatgctggga

SEQ ID NO: 8551 - DNA, 451 bp, Artificial
  TaSBEIIa allele with mutations introduced by TALEN pair TaSBEIIa_T02
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgaccaaaggagttaaggaactagtcgtgggggagaaaccgcgagttgtcccaaaaaccaggagatgggcagaaaatatacgagattgacccaacactgaaagattttcggagccatcttgactaccggtaatgcctaccgctgctttcgctcattttgaatttaaggtcctttcatcatgcaaatttggggaacatcaaagagacaaagactagggaccaccatttcatacagatccctcgtggtctgagaatatgctggga

SEQ ID NO: 8552 - DNA, 456 bp, Artificial
  TaSBEIIa allele with mutations introduced by TALEN pair TaSBEIIa_T02
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcgatggtgtaaccaaaggagttaaggaactagtcgtgggggagaaaccgcgagttgtcccaaaaaccaggagatgggcaggaaaatatacgagattgacccaacactgaaagattttcggagccatcttgactaccggtaatgcctaccgctgctttcgctcattttgaattaaggtcctttcatcatgcaaatttggggaacatcaaagagacaaagactagggaccaccatttcatacagatccctcgtggtctgagaatatgctggga

SEQ ID NO: 8553 - DNA, 453 bp, Artificial; identical to SEQ ID NO: 7777
  TaSBEIIa allele with mutations introduced by TALEN pair TaSBEIIa_T02

SEQ ID NO: 8554 - DNA, 391 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaaaccgcgagttgtcccaaaaccaggagatgggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8555 - DNA, 425 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcaaaggagttaaggaactagtcgtgggggagaaaccgcgagttgtcccaaaaccaggagatgggcagaaaaatatacgagattgacccaacgctgaaagattttcggagccatcttgactaccggtaatgcctacccgctacttcgctcattttgaattaaggtcctttcgtcatgcaaatttggggtaacatcaaagagacaaagactagggaccactatttcttacagttcccctcatggtctgagaatatgctggga

SEQ ID NO: 8556 - DNA, 411 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggggactgcagaaaaacttggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgactgggga

SEQ ID NO: 8557 - DNA, 391 bp, Artificial; identical to SEQ ID NO: 8271
  TaSBEIIa allele with mutations introduced by TALEN pair TaSBEIIa_T02

SEQ ID NO: 8558 - DNA, 424 bp, Artificial
  TaSBEIIa allele with mutations introduced by TALEN pair TaSBEIIa_T02
tcagatggatgtgcattactagcaagaacttcacgaaataatgcactgtttgtggtttcgttagtctgctctacaattgctattttcgtgctgtagatacctgaagacatcgaggagcaaacggctgaagtaaacatgacaggggggactgcagaaagtgtaaccaaaggagttaaggaactagtcgtgggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8559 - DNA, 445 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcaccaaaggagttaaggaactagtcgtgggggagaaaccgcgagttgtcccaaaaaccaggagatgggcagaaaatatacgagattgacccaacgctgaaagatttcggagccatcttgactaccggtaatgcctacccgctactttcgctcattttgaattaaggtcctttcgtcatgcaaatttgggaacatcaaagagacaaagactagggaccactatttcttacagttcccctcatggtctgagaatatgctggga

SEQ ID NO: 8560 - DNA, 431 bp, Artificial; identical to SEQ ID NO: 8438
  TaSBEIIa allele with mutations introduced by TALEN pair TaSBEIIa_T02

SEQ ID NO: 8561 - DNA, 450 bp, Artificial
  TaSBEIIa allele with mutations introduced by TALEN pair TaSBEIIa_T02
  misc_feature (248): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgatcactgatggtgtaaccaaaggagttaaggaactagtcgtgggggagaaaccgcgagttgtcccaaaaccnggagatgggcagaaatatacgagattgacccaacgctgaaagattttcggagccatcttgactaccggtaatgcctacccgctacttcgctcattttgaattaaggtcctttcgtcatgcaaatttggggaacatcaaagagacaaagactagggaccactatttcttacagttcccctcatggtctgagaatatgctggga

SEQ ID NO: 8562 - DNA, 460 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactaggggaccactatttcttacagttcccctcatggtctgagaatatgctggga

SEQ ID NO: 8563 - DNA, 466 bp, Artificial; identical to SEQ ID NO: 7985
  TaSBEIIa allele with mutations introduced by TALEN pair TaSBEIIa_T02

SEQ ID NO: 8564 - DNA, 439 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcaggagttaaggaactagtcgcgggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 8565 - DNA, 454 bp, Artificial; identical to SEQ ID NO: 8389
  TaSBEIIa allele with mutations introduced by TALEN pair TaSBEIIa_T02

SEQ ID NO: 8566 - DNA, 431 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcttcgtcatgcaaatttggggaacatcaaagagacaaagactagggaccactatttcttacagttcccctcatggtctgagaatatgctggga

SEQ ID NO: 8567 - DNA, 459 bp, Artificial
  TaSBEIIa allele with mutations introduced by TALEN pair TaSBEIIa_T02
  misc_feature (437): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagctagggaccactatttcttacagttcccctnatggtctgagaatatgctggga

SEQ ID NO: 8568 - DNA, 343 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacaactagtcgtgggggagaaaccgcgagttgtcccaaaaccaggagatgggcagaaaatatacgagattgacccaacgctgaagattttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 8569 - DNA, 381 bp, Artificial; identical to SEQ ID NO: 7926
  TaSBEIIa allele with mutations introduced by TALEN pair TaSBEIIa_T02

SEQ ID NO: 8570 - DNA, 455 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattggtgtaaccaaaggagttaaggaactagtcgtgggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattcttacagttcccctcatggtctgagaatatgctggga

SEQ ID NO: 8571 - DNA, 457 bp, Artificial; identical to SEQ ID NO: 8062
  TaSBEIIa allele with mutations introduced by TALEN pair TaSBEIIa_T02

SEQ ID NO: 8572 - DNA, 421 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgggggagaaaccgcgagttgtcccaaaaaccaggagatgggcagaaaatatacgagattgacccaacactgaaagattttcggagccatcttgactaccggtaatgcctacccgctgctttcgctcattttgaattaaggtcctttcatcatgcaaatttgggaacatcaaagagacaaagactagggaccacattcatacagatcccctcgtggtctgagaatatgctggga

SEQ ID NO: 8573 - DNA, 449 bp, Artificial; identical to SEQ ID NO: 7962
  TaSBEIIa allele with mutations introduced by TALEN pair TaSBEIIa_T02

SEQ ID NO: 8574 - DNA, 457 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagatatgctggga

SEQ ID NO: 8575 - DNA, 453 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattggtgtaaccaaaggagttaaggaactagtcgtgggggagaaaccgcgagttgtcccaaaaaccaggagatgggcagaaaatatacgagattgacccaacgctgaaagattttcggagccatcttgactaccggtaatgcctaccgctactttcgctcattttgaattaaggtcctttcgtcatgcaaatttggggaacatcaaagagacaaagactagggaccactattcttacagttccctcatggtctgagaatatgctggga

SEQ ID NO: 8576 - DNA, 364 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttgggaacatcaaagagacaaagactagggaccactattcttacagttccctcatggtctgagaatatgctggga

SEQ ID NO: 8577 - DNA, 440 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtccttttcgtcatgcaaatttggggaacatcaaagagacaaagactagggaccactatttcttacagttcccctcatggtctgagaatatgctggga

SEQ ID NO: 8578 - DNA, 431 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcaccaaaggagttaaggaactagtcgtgggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8579 - DNA, 467 bp, Artificial; identical to SEQ ID NO: 8006
  TaSBEIIa allele with mutations introduced by TALEN pair TaSBEIIa_T02

SEQ ID NO: 8580 - DNA, 430 bp, Artificial
  TaSBEIIa allele with mutations introduced by TALEN pair TaSBEIIa_T02
  misc_feature (244): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggaactagtcgtgggggagaaaccgcgagttgtcccaaaaaccaggagatgggcagaaaatntacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8581 - DNA, 458 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcactgatggtgtaaccaaaggagttaaggaactagtcgtgggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttctacagttcccctcatggtctgagaatatgctggga

SEQ ID NO: 8582 - DNA, 393 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacaaaggagttaaggaactagtcgcgggggagaaaccgcgagttgtcccaaaaccaggagatgggcagaaaatatacgagattgacccaacgctgaaagattttcggagccatcttgactaccggtaatgcctacccgctaatttcgctcatttgaattaaggtccttcatcatgcaaatttggggaacatcaaagaggcaaagactagggaccactatttcaatacagttccctcatggtctgagaatatgctggga

SEQ ID NO: 8583 - DNA, 393 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgagaaaccgcgagttgtcccaaaaaccaggagatgggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactaggaccactatttcttacagttcccctcatggtctgagaatatgctggga

SEQ ID NO: 8584 - DNA, 429 bp, Artificial; identical to SEQ ID NO: 7672
  TaSBEIIa allele with mutations introduced by TALEN pair TaSBEIIa_T02

SEQ ID NO: 8585 - DNA, 438 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaaggagttaaggaactagtcgtgggggagaaaccgcgagttgtcccaaaaccaggagatgggcagaaaaatatacgagattgacccaacgctgaaagattttcggagccatcttgactaccggtaatgcctaccgctactttcgctcattttgaattaaggtcctttcgtcatgcaaatttggggaacatcaaagagacaaagactagggaccactatttcttacagttcccctcatggtctgagaatatgctggga

SEQ ID NO: 8586 - DNA, 443 bp, Artificial
  TaSBEIIa allele with mutations introduced by TALEN pair TaSBEIIa_T02
tcagatggatgtgcattctagcaagaacttcacaaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcaaaggagttaaggaactagtcgcggggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttgggaacatcaaagaggcaaagactagggacccactatttcatacagttcccctcatggtctgagaatatgctggga

SEQ ID NO: 8587 - DNA, 323 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctatttttcgtgtgctgtagaaaccgcgagttgtcccaaaaccaggagatgggcagaaaatatacgagattgacccaacgctgaaagattttcggagccatcttgactaccggtaatgcctaccgctaatttcgctcattttgaattaaggtcctttcatcatgcaaatttgggaacatcaaagaggcaaagactagggaccactatttcatacagttccctcatggtctgagaatatgctggga

SEQ ID NO: 8588 - DNA, 460 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattcttacagttcccctcatggtctgagaatatgctggga

SEQ ID NO: 8589 - DNA, 390 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgagaaaccgcgagttgtcccaaaaccaggagatgggcagaaaatatacgagattgacccaacgctgaaagatttcggagccatcttgactaccggtaatgcctacccgctactttcgctcattttgaattaaggtccttgtcatgcaaatttggggaacatcaaagagacaaagactagggaccactatttcttacagttcccctcatggtctgagaattatgctggga

SEQ ID NO: 8590 - DNA, 406 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttggaactagtcgtggggagaaaccgcgagttgtccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8591 - DNA, 457 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgggtgtaaccaaaggagttaaggaactagtcgtgggggagaaaccgcgagttgtcccaaaaccaggagatgggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8592 - DNA, 415 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattcttacagttcccctcatggtctgagaatatgctggga

SEQ ID NO: 8593 - DNA, 434 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttggatggtgtaaccaaaggagttaaggaactagtcgtgggggagaaaccgcgagttgtcccaaaaccaggagatgggcagaaaaatatacgagattgacccaacgctgaaagattttcggagccatcttgactaccggtaatgcctacccgctactttcgctcattttgaattaaggtcctttcgtcatgcaaattttggggaacatcaaagagacaaagactagggaccactatttcttacagttcccctcatggtctgagaatatgctggga

SEQ ID NO: 8594 - DNA, 402 bp, Artificial; identical to SEQ ID NO: 8023
  TaSBEIIa allele with mutations introduced by TALEN pair TaSBEIIa_T02

SEQ ID NO: 8595 - DNA, 339 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccacatttc

SEQ ID NO: 8596 - DNA, 467 bp, Artificial
  TaSBEIIa allele with mutations introduced by TALEN pair TaSBEIIa_T02
tcaaatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgcaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8597 - DNA, 455 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgatggtgtaaccaaaggagttaaggaactagtcggtgggggagaaaccgcgagttgtcccaaaaccaggagatgggcagaaaatatacgagattgacccaacgctgaaagattttcggagccatcttgactaccggtaatgcctaccgctactttcgctcattttgaattaaggtcctttcgtcatgcaaatttggggaacatcaagagacaaagactaggaccactatttcttacagttccctcatggtctgagaatatgctggga

SEQ ID NO: 8598 - DNA, 457 bp, Artificial; identical to SEQ ID NO: 8168
  TaSBEIIa allele with mutations introduced by TALEN pair TaSBEIIa_T02

SEQ ID NO: 8599 - DNA, 409 bp, Artificial; identical to SEQ ID NO: 8544
  TaSBEIIa allele with mutations introduced by TALEN pair TaSBEIIa_T02

SEQ ID NO: 8600 - DNA, 438 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaaggagttaaggaactagtcgtgggggagaaaccgcgaagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactaagggaccactatttctacagttccctcatggtctgagaatatgctggga

SEQ ID NO: 8601 - DNA, 200 bp, Artificial; identical to SEQ ID NO: 7622
  TaSBEIIa allele with mutations introduced by TALEN pair TaSBEIIa_T02

SEQ ID NO: 8602 - DNA, 466 bp, Artificial; identical to SEQ ID NO: 7285
  TaSBEIIa allele with mutations introduced by TALEN pair TaSBEIIa_T02

SEQ ID NO: 8603 - DNA, 389 bp, Artificial; identical to SEQ ID NO: 7817
  TaSBEIIa allele with mutations introduced by TALEN pair TaSBEIIa_T02

SEQ ID NO: 8604 - DNA, 443 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcaatcactgatggtgtaaccaaaggagttaaggaactagtcgtgggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaatttgggaacatcaaagagacaaagactagggaccactatttcttacagttcccctcatggtctgagaatatgctggga

SEQ ID NO: 8605 - DNA, 412 bp, Artificial
  TaSBEIIa allele with mutations introduced by TALEN pair TaSBEIIa_T02
  misc_feature (389): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatctgaactagtcgtggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccatatttcttacagttccccncatggtctgagaatatgctggga

SEQ ID NO: 8606 - DNA, 444 bp, Artificial; identical to SEQ ID NO: 8496
  TaSBEIIa allele with mutations introduced by TALEN pair TaSBEIIa_T02

SEQ ID NO: 8607 - DNA, 453 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaattttggggaacatcaaagagacaaagactagggaccactatttcttacagttcccctcatggtctgagaatatgctggga

SEQ ID NO: 8608 - DNA, 347 bp, Artificial
  TaSBEIIa allele with mutations introduced by TALEN pair TaSBEIIa_T02
tcagatggatggtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8609 - DNA, 453 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattcttacagttcccctcatggtctgagaatatgctggga

SEQ ID NO: 8610 - DNA, 464 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcaggacaatcactgatggtgtaaccaaaggagttaaggaactagtcgcgggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttgggaacatcaaagaggcaaagactagggaccactatttcatacagttcccctcatggtctgagaatatgctggga

SEQ ID NO: 8611 - DNA, 416 bp, Artificial
  TaSBEIIa allele with mutations introduced by TALEN pair TaSBEIIa_T02
tcagatggatgtgcattctagcaagaacttcaacgaaataatgcactgtttgtggtttcgttagtctgctctacaattgctattttcgtgctgtagatacctgaagacatcgaggagcaaacggctgaagtaaacatgacaggggggactgcagaaaaacttgaatctgaactagtcgtgggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacacgttcccctcatggtctgagaatatgctggga

SEQ ID NO: 8612 - DNA, 442 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaaggagttaaggaactagtcgtgggggagaaaccgcgagttgtacccaaaaccaggagatgggcaagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttacccctcatggtctgagaatatgctggga

SEQ ID NO: 8613 - DNA, 200 bp, Artificial; identical to SEQ ID NO: 7622
  TaSBEIIa allele with mutations introduced by TALEN pair TaSBEIIa_T02

SEQ ID NO: 8614 - DNA, 463 bp, Artificial; identical to SEQ ID NO: 8129
  TaSBEIIa allele with mutations introduced by TALEN pair TaSBEIIa_T02

SEQ ID NO: 8615 - DNA, 393 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgcttattttcgtgctgtagatacctgaagacatcgaggagcaaacggctgaagtaaacatgacaggggggactgcagaaaaacttgagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactaggaccactatttcttacagttcccctcatggtctgaagaatatgctggga

SEQ ID NO: 8616 - DNA, 412 bp, Artificial
  TaSBEIIa allele with mutations introduced by TALEN pair TaSBEIIa_T02
  misc_feature (351): n is a or c or t or g
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaggagttaaggaactagtcgtgggggagaaaccgcgagttgtcccaaaaccaggagatgggcagaaaatatacgagattgacccaacactgaaagattttcggagccatcttgactaccggtaatgcctacccgctgctttcgctcattttgaattaaggtcctttcatcatgcaaatttgggaacatcaaagngacaaagactagggaccaccatttcatacagatcccctcgtggtctgagaatatgctggga

SEQ ID NO: 8617 - DNA, 408 bp, Artificial
  TaSBEIIa allele with mutations introduced by TALEN pair TaSBEIIa_T02
  misc_feature (386): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctnatggtctgagaatatgctggga

SEQ ID NO: 8618 - DNA, 458 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctaccgctactttcgctcattttgaattaaggtcctttcgtcatgcaaaatttggggaacatcaaagagacaaagactagggaccactatttcttacagttcccctcatggtctgagaatatgctggga

SEQ ID NO: 8619 - DNA, 435 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttgggaacatcaaagagacaaagactagggaccactattcttacagttcccctcatggtctgagaatatgctgga

SEQ ID NO: 8620 - DNA, 447 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactgatggtgtaaccaaaggagttaaggaactagtcgtgggggagaaaccgcgagttgtcccaaaacaggagatgggcagaaaatatacgagattgacccaacgctgaaagattttcggagccatcttgactaccggtaatgcctaccgctactttcgctcattttgaattaaggtcctttcgtcatgcaaatttggggaacatcaaagagacaaagactagggaccactatttcttacagttcccctcatggtctgagaatatgctggga

SEQ ID NO: 8621 - DNA, 388 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactaagggaccactatttcatacagttcccctcatggtactgagaatatgctggga

SEQ ID NO: 8622 - DNA, 421 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttaaggaactagtcgtgggggagaaaccgcgagttgtcccaaaaaccaggagatgggcagaaaatatacgagattgacccaacgctgaaagattttcggagccatcttgactaccggtaatgcctacccgctactttcgctcattttgaattaaggtacctttcgtcatgcaaatttgggaacgatcaaagagacaaagactagggaccactatttcttacagttcccctcactggtctgagaaatatgctggga

SEQ ID NO: 8623 - DNA, 447 bp, Artificial; identical to SEQ ID NO: 7798
  TaSBEIIa allele with mutations introduced by TALEN pair TaSBEIIa_T02

SEQ ID NO: 8624 - DNA, 461 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggatcactgatggtgtaaccaaaggagttaaggaactagtcgtggggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8625 - DNA, 454 bp, Artificial
  TaSBEIIa allele with mutations introduced by TALEN pair TaSBEIIa_T02
  misc_feature (287): n is a or c or t or g
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgacaatcactgatggtgtaaccaaaggagttaaggaactagtcgtgggggagaaaccgcgagttgtcccaaaaccaggagatgggcagaaaatatacgagattgacccaanactgaaagattttcggagccatcttgactaccggtaatgcctaccgctgctttcgctcattttgaattaaggtcctttcatcatgcaaatttgggaacatcaaagagacaaagactagggaccaccatttcatacagatcccctcgtggtctgagaatatgctggga

SEQ ID NO: 8626 - DNA, 424 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcaaaggagttaaggaactagtcgtggggggagaaaccgcgagttgtcccaaaaccaggagatgggcagaaaatatacgagattgacccaacgctgaaagattttcggagccatcttgactaccggtaaatgcctacccgctactttcgctcattttgaattaaggtcctttcgtcatgcaaatttggggaacatcaaagagacaaagactaggaccactattcttacagttccctcatggtctagagaatatgctggga

SEQ ID NO: 8627 - DNA, 424 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttggatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaaat

SEQ ID NO: 8628 - DNA, 460 bp, Artificial
  TaSBEIIa allele with mutations introduced by TALEN pair TaSBEIIa_T02
  misc_feature (233): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcatcactgatggtgtaaccaaaggagttaaggaactagtcgtggggganaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttgggacatcaaagagacaaagactagggaccactatttcttacagttcccctcatggtactgagaatatgctggga

SEQ ID NO: 8629 - DNA, 455 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcactgatggtgtaaccaaaggagttaaggaactagtcgtgggggagaaaccgcgagttgtcccaaaaaccaggagatgggcagaaaatatacgagattgacccaacgctgaaagattttcggaagccatcttgactaccggtaatgcctacccgctactttcgctcattttgaattaaggtcctttcgtcatgcaaatttggggaacatcaaagagacaaagactaggggaccactatttcttacagttcccctcatggtctgagaatatgctgga

SEQ ID NO: 8630 - DNA, 200 bp, Artificial; identical to SEQ ID NO: 7622
  TaSBEIIa allele with mutations introduced by TALEN pair TaSBEIIa_T02

SEQ ID NO: 8631 - DNA, 461 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttgggaacatcaaagagaacaaagactagggaccactattcttacagttcccctcatggtctgagaatatgctgga

SEQ ID NO: 8632 - DNA, 459 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcactgatggtgtaaccaaaggagttaaggaactagtcgtgggggagaaaccgcgagttgtacccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8633 - DNA, 438 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcactgatggtgtaaccaaaggagttaaggaactagtcgtgggggagaaaccgcgagttgtcccaaaaccaggagatgggcagaaaatatacagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8634 - DNA, 446 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8635 - DNA, 456 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggtgtaaccaaaggagttaaggaactagtcgtgggggagaaaccgcgagttgtcccaaaaccaggagatgggcagaaaatatacgagattgacccaacgctagaaagattttcggagccatcttgactaccggtaatgcctacccgctactttcgctcattttgaattaaggtcctttcgtcatgcaaatttggggaacatcaaagagacaaagactaggaccactattcttacagttcccctcatggtctgagaatatgctggga

SEQ ID NO: 8636 - DNA, 394 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgagaaaccgcgagttgtcccaaaaaccaggagatgggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8637 - DNA, 454 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtgtaaccaaaggagttaaggaactagtcgtgggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattcttacagttcccctcatggtctgagaatatgctggga

SEQ ID NO: 8638 - DNA, 448 bp, Artificial
  TaSBEIIa allele with mutations introduced by TALEN pair TaSBEIIa_T02
  misc_feature (388): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactatggtgtaaccaaaggagttaaggaactagtcgtgggggagaaaccgcgagttgtcccaaaaccaggagatgggcagaaaaatatacgagattgacccaacgctgaaagattttcggagccatcttgactaccggtaatgcctacccgctactttcgctcattttgaattaaggtcctttcgtcatgcaaatttggggaacatcaaagngacaaagactagggaccactatttctacagttcccctcatggtctgagaatatgctggga

SEQ ID NO: 8639 - DNA, 385 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttgggaacatcaaagaggcaaagactagggaccactatttcatacagttcccctcatggtctgagaatatgctggga

SEQ ID NO: 8640 - DNA, 463 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgcactgatggtgtaaccaaaggagttaaggaactagtcgtgggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaatttgggaacatcaaagagacaaagactagggaccactatttcttacagttcccctcatggtctgagaatatgctggga

SEQ ID NO: 8641 - DNA, 440 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaaggagttaaggaactagtcgtgggggagaaaccgcgagttgtcccaaaaaccaggagatgggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8642 - DNA, 383 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttgggaacatcaaagagacaaagactagggaccactatttcttacagttcccctcatggtctgagaatatgctggga

SEQ ID NO: 8643 - DNA, 465 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcatcaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccgataatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8644 - DNA, 390 bp, Artificial; identical to SEQ ID NO: 7695
  TaSBEIIa allele with mutations introduced by TALEN pair TaSBEIIa_T02

SEQ ID NO: 8645 - DNA, 442 bp, Artificial
  TaSBEIIa allele with mutations introduced by TALEN pair TaSBEIIa_T02
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacagggggggactgcagagaaacttcaatcttcagaaccgactcaaaggagttaaggaactagtcgtgggggagaaaccgcgagttgtcccaaaaaccaggagatgggcagaaaatatacgagattgacccaacactgaaagattttcggagccatcttgactaccggtaatgcctacccgctgctttcgctcattttgaatttaaggtcctttcatcatgcaaatttggggaacatcaaagagacaaagactagggaccaccatttcatacagatcccctcgtggtctgagaatatgctggga

SEQ ID NO: 8646 - DNA, 457 bp, Artificial; identical to SEQ ID NO: 8168
  TaSBEIIa allele with mutations introduced by TALEN pair TaSBEIIa_T02

SEQ ID NO: 8647 - DNA, 423 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaagtgtaaccaaaggagttaaggaactagtcgtgggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8648 - DNA, 424 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaatttggggaacatcaaagagacaaagactagggaccactatttcttaacagttcccctcatggtctgagaatatgctggga

SEQ ID NO: 8649 - DNA, 468 bp, Artificial
  TaSBEIIa allele with mutations introduced by TALEN pair TaSBEIIa_T02
  misc_feature (463): n is a or c or t or g
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattaatcactgatggtgtaaccaaaggagttaaggaactagtcgcgggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgntggga

SEQ ID NO: 8650 - DNA, 447 bp, Artificial
  TaSBEIIa allele with mutations introduced by TALEN pair TaSBEIIa_T02
  misc_feature (242): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggagttaaggaactagtcgtgggggagaaaccgcgagttgtcccaaaaaccnggagatgggcagaaaatatacgagattgacccaacgctgaaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8651 - DNA, 439 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaaggagttaaggaactagtcgtgggggagaaaccgcgagttgtcccaaaaacaggagatgggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8652 - DNA, 425 bp, Artificial; identical to SEQ ID NO: 8131
  TaSBEIIa allele with mutations introduced by TALEN pair TaSBEIIa_T02

SEQ ID NO: 8653 - DNA, 458 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattcttacagttcccctcatggtctgagaatatgctgga

SEQ ID NO: 8654 - DNA, 456 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctaccgctactttcgctcattttgaattaaggtcctttcgtcatgctaaatttgggaacatcaaagagacaaagactaggaccactatttcttacacgttccctcatggtctgagaatatgctggga

SEQ ID NO: 8655 - DNA, 467 bp, Artificial
  TaSBEIIa allele with mutations introduced by TALEN pair TaSBEIIa_T02
tcaaatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgcaatcactgatggtgtaaccaaaggagttaaggaactagtcgtgggggagaaaccgcgagttgtcccaaaaccaggagatgggcagaaaatatacgagattgacccaacgctgaaagtattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctgga

SEQ ID NO: 8656 - DNA, 458 bp, Artificial
  TaSBEIIa allele with mutations introduced by TALEN pair TaSBEIIa_T02
  misc_feature (231): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcactgatggtgtaaccaaaggagttaaggaactagtcgtgggggganaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttctacagttcccctcatggtctgagaatatgctggga

SEQ ID NO: 8657 - DNA, 417 bp, Artificial; identical to SEQ ID NO: 8291
  TaSBEIIa allele with mutations introduced by TALEN pair TaSBEIIa_T02

SEQ ID NO: 8658 - DNA, 442 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactaaaggagttaaggaactagtcgcgggggagaaaccgcgagttgtcccaaaaaccaggagatgggcaagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 8659 - DNA, 430 bp, Artificial
  TaSBEIIa allele with mutations introduced by TALEN pair TaSBEIIa_T02
  misc_feature (202); (226); (244): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattggtcgtgggggganaaaccgcgagttgtcccaaaaccnggagatgggcagaaaatntacgagattgacccaacgctgaaagattttcggagccatcttgactaccggtaatgcctacccgctactttcgactcattttgaattaaggtcctttcgtcatgcaaatttggggaacatcaaagagacaaagactagggaccactatttcttacagttccctcatggtctgagaatatgctggga

SEQ ID NO: 8660 - DNA, 384 bp, Artificial; identical to SEQ ID NO: 7781
  TaSBEIIa allele with mutations introduced by TALEN pair TaSBEIIa_T02

SEQ ID NO: 8661 - DNA, 466 bp, Artificial
  TaSBEIIa allele with mutations introduced by TALEN pair TaSBEIIa_T02
  misc_feature (239): n is a or c or t or g
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcaggaaacaatcactgatggtgtaaccaaaggagttaaggaactagtcgcggggganaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttgggaacatcaaagaggcaaagactagggaccactatttcatacagttcccctcatggtctgagaatatgctggga

SEQ ID NO: 8662 - DNA, 409 bp, Artificial
  TaSBEIIa allele with mutations introduced by TALEN pair TaSBEIIa_T02
  misc_feature (348): n is a or c or t or g
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaaccaaaggagttaaggaactagtcgcgggggagaaaccgcgagttgtcccaaaaccaggagatgggcagaaaatatacgagattgacccaacgctgaaagatttcggagccatcttgactaccggtaatgcctacccgctaatttcgctcattttgaattaaggtcctttcatcatgcaaatttgggaacatcaaagnggcaaagactagggaccactatttcatacagttcccctcatggtctgagaatatgctggga

SEQ ID NO: 8663 - DNA, 433 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttggatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaattttggggaacatcaaagagacaaagactagggaccactatttcttacagttcccctcatggtctgagaatatgctggga

SEQ ID NO: 8664 - DNA, 347 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaatatacgagattgacccaacgctgaaagattttcggagccatcttgactaccggtaatgcctacccgctactttcgctcattttgaattaaggtcctttcgtcatgcaaatttggggaacatacaaagagacaaagactagggaccactatttcttacagttcccctcatggtctgagaatatgctggga

SEQ ID NO: 8665 - DNA, 461 bp, Artificial; identical to SEQ ID NO: 7831
  TaSBEIIa allele with mutations introduced by TALEN pair TaSBEIIa_T02

SEQ ID NO: 8666 - DNA, 453 bp, Artificial
  TaSBEIIa allele with mutations introduced by TALEN pair TaSBEIIa_T02
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcactgatggtgtaaccaaaggagttaaggaactagtcgtgggggagaaaccgcgagttgtcccaaaaaccaggagatgggcagaaaatatacgagattgacccaacactgaaagattttcggagccatcttgactaccggtaatgcctaccgctgctttcgctcattttgaattaaggtcctttcatcatgcaaatttggggaacatcaaagagacaaagactagggaccacattcatacagatcccctcgtggtctgagaataatgctggga

SEQ ID NO: 8667 - DNA, 458 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctatttttcgtgctgtagatacctgaagacatcgaggagcaaacggctgaagtaaacatgacaggggggactgcagaaaaacttgaatcttcagaaccgactcaatcactgatggtgtaaccaaaggagttaaggaactagtcgtgggggagaaaccgcgagttgtcccaaaaccaggagatgggcagaaaatatacgagattgaacccaacgctgaaagattttcggagccatcttgactaccggtaatgcctacccgctactttcgctcattttgaattaaggtcctttcgtcatgcaaatttggggaacatcaaagagacaaagactaggaccactatttcttacagttcccctcatggtctgagaatatgctggga

SEQ ID NO: 8668 - DNA, 367 bp, Artificial; identical to SEQ ID NO: 7647
  TaSBEIIa allele with mutations introduced by TALEN pair TaSBEIIa_T02

SEQ ID NO: 8669 - DNA, 350 bp, Artificial; identical to SEQ ID NO: 7898
  TaSBEIIa allele with mutations introduced by TALEN pair TaSBEIIa_T02

SEQ ID NO: 8670 - DNA, 462 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcatcaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtccttcgtcatgcaaatttggggaacatcaaagagacaaagactagggaccactattcttacagttccctcatggtctgagaatatgctggga

SEQ ID NO: 8671 - DNA, 463 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcggaaacaatcactgatggtgtaaccaaaggagttaaggaactagtcgtggggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttgggaacatcaaagagacaaagactagggaccactatttcttacagttcccctcatggtctgagaatatgctggga

SEQ ID NO: 8672 - DNA, 380 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactaggaccactatttcttacagttcccctcatggtctgagaatatgctggga

SEQ ID NO: 8673 - DNA, 457 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattatggtgtaaccaaaggagttaaggaactagtcgtggggggagaaaccgcgagttgtcccaaaaaccaggagatgggcagaaaatatacgagattgacccaacgctgaaagattttcggagccatcttgactaccggtaatgcctaccgctactttcgctcattttgaattaaggtcctttcgtcatgcaaatttggggaacatcaaagagacaaagactagggaccactattcttacagttcccctcatggtctgagaatatgctggga

SEQ ID NO: 8674 - DNA, 408 bp, Artificial; identical to SEQ ID NO: 7710
  TaSBEIIa allele with mutations introduced by TALEN pair TaSBEIIa_T02

SEQ ID NO: 8675 - DNA, 479 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggaacattgtggaaacaatcactgatggtgtaaccaaaggagttaaggaactagtcgcgggggagaaaccgcgagttgtcccaaaaccaggagatgggcagaaaatatacgagattgacccaacgctgaaagattttcggagccatcttgactaccggtaatgcctacccgctaatttcgctcattttgaatttaaggtcctttcatcatgcaaatttggggaacatcaaagaggcaaagactagggaccactatttcatacagttcccctcatggtctgagaatatgctggga

SEQ ID NO: 8676 - DNA, 411 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatctgaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagatgctgggga

SEQ ID NO: 8677 - DNA, 417 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctacttcgctcattttgaattaaggtcctttcgtcatgcaaatttggggaacatcaaagagacaaagactagggaccactatttcttacagttcccctcatggtctgagaatatgctggga

SEQ ID NO: 8678 - DNA, 443 bp, Artificial
  TaSBEIIa allele with mutations introduced by TALEN pair TaSBEIIa_T02
  misc_feature (212); (237): n is a or c or t or g
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccaaccaaaggagttaaggaactagtcgcggggganaaaccgcgagttgtcccaaaaaccnggagatggggcaagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 8679 - DNA, 439 bp, Artificial; identical to SEQ ID NO: 8564
  TaSBEIIa allele with mutations introduced by TALEN pair TaSBEIIa_T02

SEQ ID NO: 8680 - DNA, 440 bp, Artificial; identical to SEQ ID NO: 8126
  TaSBEIIa allele with mutations introduced by TALEN pair TaSBEIIa_T02

SEQ ID NO: 8681 - DNA, 456 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttccctcatggtctgagaatatgctgga

SEQ ID NO: 8682 - DNA, 457 bp, Artificial
  TaSBEIIa allele with mutations introduced by TALEN pair TaSBEIIa_T02
  misc_feature (271): n is a or c or t or g
tcagatggatgttgcattactagcaagaacttcacgaaataatgcgactgtttgtggtttcgttagtctgctctacaattgctattttcgtgctgtagatacctgaagacatcgaggagcaaacggctgaagtaaacatgacaggggggactgcagaaaaacttgaatcttcagaaccgatcactgatggtgtaaccaaaggagttaaggaactagtcgtgggggagaaaccgcgagttgtcccaaaaaccaggagatgggcagaaaaatntacgagattgacccaacgctgaaagatttcggagccatcttgactaccggtaatgcctacccgctactttcgctcattttgaattaaggtcctttcgtcatgcaaattttggggaacatcaaagagacaaagactagggaccactatttcttacagttcccctcatggtctgagaatatgctggga

SEQ ID NO: 8683 - DNA, 440 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccaaccaaaggagttaaggaactagtcgcgggggagaaaccgcgagttgtcccaaaaaccaggagatgggcagaaaatatacgagattgacccaacgctgaaagatttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 8684 - DNA, 452 bp, Artificial
  TaSBEIIa allele with mutations introduced by TALEN pair TaSBEIIa_T02
  misc_feature (228): n is a or c or t or g
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcgatggtgtaaccaaaggagttaaggaactagtcgtggggganaaaccgcgagttgtcccaaaaccaggagatgggcagaaaatatacgagattgacccaacactgaaagattttcggagccatcttgactaccggtaatgcctacccgctgctttcgctcattttgaattaaggtcctttcatcatgcaaatttgggaacatcaagagacaaagactaggaccacattcatacagatcccctcgtggtctgagaatatgactggga

SEQ ID NO: 8685 - DNA, 384 bp, Artificial; identical to SEQ ID NO: 7781
  TaSBEIIa allele with mutations introduced by TALEN pair TaSBEIIa_T02

SEQ ID NO: 8686 - DNA, 461 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcatcactgatggtgtaaccaaaggagttaaggaactagtcgtgggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagatatgctggga

SEQ ID NO: 8687 - DNA, 451 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctaccgctacttcgctcattttgaattaaggtcctttcgtcatgcaaattttggggaacatcaaagagacaaagactagggaccactattcttacagttccctcatggtctgagaatatgctggga

SEQ ID NO: 8688 - DNA, 425 bp, Artificial; identical to SEQ ID NO: 7859
  TaSBEIIa allele with mutations introduced by TALEN pair TaSBEIIa_T02

SEQ ID NO: 8689 - DNA, 450 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactatggtgtaaccaaaggagttaaggaactagtcgtgggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcactggtctgagaatatgctggga

SEQ ID NO: 8690 - DNA, 417 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8691 - DNA, 277 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgcctggga

SEQ ID NO: 8692 - DNA, 459 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattcttacagttcccctcatggtctagagaatatgcgtggga

SEQ ID NO: 8693 - DNA, 374 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtgaactagtcgtgggggagaaaccgcgagttgtcccaaaaaccaggagatgggcagaaaatatacgagattgacccaacgctgaaagattttcggagccatcttgactaccggtaatgcctacccgctactttcgctcatttgaattaaggtcctttcgtcatgcaaatttggggaacatcaaagagacaaagactagggaccactattcttacagttccctcatggtctgagaatatgctggga

SEQ ID NO: 8694 - DNA, 367 bp, Artificial; identical to SEQ ID NO: 7647
  TaSBEIIa allele with mutations introduced by TALEN pair TaSBEIIa_T02

SEQ ID NO: 8695 - DNA, 420 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactagtcgtgggggagaaaccgcgagttgtcccaaaaccaggagatgggcagaaaatatacgagattgacccaacgctgaaagattttcggagccatcttgacaaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8696 - DNA, 412 bp, Artificial; identical to SEQ ID NO: 8116
  TaSBEIIa allele with mutations introduced by TALEN pair TaSBEIIa_T02

SEQ ID NO: 8697 - DNA, 425 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcaaaggagttaaggaactagtcgtgggggagaaaccgcgagttgtcccaaaaccaggagatgggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8698 - DNA, 190 bp, Artificial; identical to SEQ ID NO: 7632
  TaSBEIIa allele with mutations introduced by TALEN pair TaSBEIIa_T02

SEQ ID NO: 8699 - DNA, 461 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggacaatcactgatggtgtaaccaaaggagttaaggaactagtcgtgggggagaaaccgcgagttgtcccaaaaccaggagatgggcagaaaatatacgagattgaccaacgctgaaagattttcggagccatcttgactaccggtaatgcctacccgctactttcgctcatttgaattaaggtcctttcgtcatgcaaatttggggaacatcaaagagacaaagactagggaccactatttcttacagttcccctcatggtctgagaatatgctggga

SEQ ID NO: 8700 - DNA, 344 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattcttacagttacccctcatggtctgagaatatgctggga

SEQ ID NO: 8701 - DNA, 470 bp, Artificial; identical to SEQ ID NO: 7331
  TaSBEIIa allele with mutations introduced by TALEN pair TaSBEIIa_T02

SEQ ID NO: 8702 - DNA, 453 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagatatgctgga

SEQ ID NO: 8703 - DNA, 376 bp, Artificial; identical to SEQ ID NO: 7657
  TaSBEIIa allele with mutations introduced by TALEN pair TaSBEIIa_T02

SEQ ID NO: 8704 - DNA, 463 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggacaatcactgatggtgtaaccaaaggagttaaggaactagtcgtgggggagaaaccgcgagttgtcccaaaaaccaggagatgggcagaaaatatacgagattgacccaacgctgaaagattttcggagccatcttgactaccggtaatgcctaccgctactttcgctcattttgaattaaggtcctttgtcatgcaaatttggggaacatcaaagagacaaagactagggaccactatttcttaacagttcccctcatggtctgagaatatgctggga

SEQ ID NO: 8705 - DNA, 460 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcactgatggtgtaaccaaaggagttaaggaactagtcgtggggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcaatgcaaatttggggaacatcaaagagacaaagactagggaccactattcttacagttcccctcatggtctgagaatatgctggga

SEQ ID NO: 8706 - DNA, 425 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaccaaaggagttaaggaactagtcgtgggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcattgcaaatttggggaacatcaaagagacaaagactagggaccactatttcttacagttcccctcatggtctgagaatatgctggga

SEQ ID NO: 8707 - DNA, 458 bp, Artificial; identical to SEQ ID NO: 8039
  TaSBEIIa allele with mutations introduced by TALEN pair TaSBEIIa_T02

SEQ ID NO: 8708 - DNA, 463 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagaacaaagactagggaccactatttcttacagttcccctcatggtctgagaatatgctggga

SEQ ID NO: 8709 - DNA, 413 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaaccaaaggagttaaggaactagtcgcgggggagaaaccgcgagttgtcccaaaaaccaggagatgggcagaaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 8710 - DNA, 456 bp, Artificial; identical to SEQ ID NO: 7894
  TaSBEIIa allele with mutations introduced by TALEN pair TaSBEIIa_T02

SEQ ID NO: 8711 - DNA, 440 bp, Artificial; identical to SEQ ID NO: 8070
  TaSBEIIa allele with mutations introduced by TALEN pair TaSBEIIa_T02

SEQ ID NO: 8712 - DNA, 444 bp, Artificial
  TaSBEIIa allele with mutations introduced by TALEN pair TaSBEIIa_T02
  misc_feature (217): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaactgatggtgtaaccaaaggagttaaggaactagtcgtggggganaaaccgcgagttgtcccaaaaccaggagatgggcagaaatatacgagaattgacccaacgctgaaagattttcggagccatcttgactaccggtaatgcctacccgctacttcgctcattttgaattaaggtcctttcgtcatgcaaatttggggaacatcaaagagacaaagactagggaccactatttcttacagttcccctcatggtctgagaatatgctggga

SEQ ID NO: 8713 - DNA, 450 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaattttggggaacatcaaagagacaaagactagggaccactatttcttacagttcccctcatggtctgagaatatgctggga

SEQ ID NO: 8714 - DNA, 467 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgcaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttccctcactggtctgagaatatgctggga

SEQ ID NO: 8715 - DNA, 458 bp, Artificial
  TaSBEIIa allele with mutations introduced by TALEN pair TaSBEIIa_T02
  misc_feature (230): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgatggtgtaaccaaaggagttaaggaactagtcgtggggganaaaccgcgagttgtcccaaaaccaggagatgggcagaaaatatacgagattgacccaacgctgaaagattttcggagccatcttgactaccggtaatgcctacccgctactttcgctcattttgaatttaaggtcctttcgtcatgcaaatttggggaacatcaaagagacaaagactagggaccactatttcttacagttccctcatggtctgagaatatgctggga

SEQ ID NO: 8716 - DNA, 458 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgatggtgtaaccaaaggagttaaggaactagtcgtgggggagaaaccgcgagttgtcccgaaaaccaggagatgggcagaaaatatacgagattgacccaacgctgaaagattttcggagccatcttgactaccggtaatgcctaccgctactttcgctcattttgaattaaggtcctttcgtcatgcaaatttggggaacatcaaagagacaaagactagggaccactatttcttacagttcccctcatggtctgagaatatgctggga

SEQ ID NO: 8717 - DNA, 465 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaagggaacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactaggggaccactatttcttacagttcccctcatggtctgagatatgctggga

SEQ ID NO: 8718 - DNA, 462 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattcttacagttcccctcatggtctgagaatatgctggga

SEQ ID NO: 8719 - DNA, 448 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactgatggtgtaaccaaaggagttaaggaactagtcgtgggggagaaaccgcgagttgtcccaaaaccaggagatgggcagaaaatatacgagattgacccaacgctgaaagatttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8720 - DNA, 430 bp, Artificial
  TaSBEIIa allele with mutations introduced by TALEN pair TaSBEIIa_T02
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttaaccaaaggagttaaggaactagtcgtgggggagaaaccgcgagttgtcccaaaaccaggagatgggcagaaaatatacgagattgacccaacactgaaagattttcggagccatcttgactaccggtaatgcctacccgctgctttcgctcattttgaattaaggtcctttcatcatgcaaatttgggaacatcaaagagacaaagactagggaccacatttcatacagatcccctcgtggtctgagaatatagctggga

SEQ ID NO: 8721 - DNA, 419 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgcttattttcgtgctgtagatacctgaagacatcgaggagcaaacggctgaagtaaacatgacaggggggactgcagaaaaacttgaatcttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaaagactagggaccactatttcttacagttcccctcatggtctgagaatatgctggga

SEQ ID NO: 8722 - DNA, 457 bp, Artificial
  TaSBEIIa allele with mutations introduced by TALEN pair TaSBEIIa_T02
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgacaatcactgatggtgtaaccaaaggagttaaggaactagtcgtgggggagaaaccgcgagttgtcccaaaaaccaggagatgggcagaaaatatacgagattgacccaacactgaaagattttcggagccatcttgactaccggtaatgcctaccgctgctttcgctcattttgaattaaggtcctttcatcatgcaaatttggggaacatcaaagagacaaagactaagggaccaccatttcatacagatcccctcgtggtctgagataatgctggga

SEQ ID NO: 8723 - DNA, 460 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctaccgctactttcgactcattttgaattaaggtcctttcgcatgcaaatttggggaacatcaaagagacaaagactagggaccactattcttacagttcccctcatggtctgagaatatgctggga

SEQ ID NO: 8724 - DNA, 367 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctatttttcgtgctgtagatacctgaagacatcgaggagcaaacggctgaagtaaacatgacaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagatatgctggga

SEQ ID NO: 8725 - DNA, 465 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgaatcactgatggtgtaaccaaaggagttaaggaactagtcgtgggggagaaaccgcgagttgtcccaaaaccaggagatgggcagaaaatatacgagattgacccaagctgaaagattttcggagccatcttgactaccggtaatgcctaccgctactttcgctcattttgaattaaggtcctttcgtcatgcaaatttggggaacatcaaagagacaaagactagggaccactatttcttacacgttcccctcatggtctgagaatatgctggga

SEQ ID NO: 8726 - DNA, 457 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattggtgtaaccaaaggagttaaggaactagtcgtgggggagaaaccgcgagttgtcccaaaaaccaggagatgggcagaaaaatatacgagattgacccaacgctgaaagattttcggagccatcttgactaccggtaatgcctaccgctactttcgctcattttgaattaaggtcctttcgtcatgcaaatttggggaacatcaaagagacaaagactagggaccactatttcttacagttcccctcactggtctgagaatatgctggga

SEQ ID NO: 8727 - DNA, 408 bp, Artificial; identical to SEQ ID NO: 7710
  TaSBEIIa allele with mutations introduced by TALEN pair TaSBEIIa_T02

SEQ ID NO: 8728 - DNA, 373 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtgaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgattaaggtcctttcgtcatgcaaatttgggaacagtcaaagagacaaagactagggaccactattcttacagttccctcatggtctgagaatatgctggga

SEQ ID NO: 8729 - DNA, 457 bp, Artificial
  TaSBEIIa allele with mutations introduced by TALEN pair TaSBEIIa_T02
  misc_feature (229): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaatcactgatggtgtaaccaaaggagttaaggaactagtcgtggggganaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8730 - DNA, 454 bp, Artificial
  TaSBEIIa allele with mutations introduced by TALEN pair TaSBEIIa_T02
tcagatggatgtgcattctagcaagaacttcacgaaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8731 - DNA, 458 bp, Artificial
  TaSBEIIa allele with mutations introduced by TALEN pair TaSBEIIa_T02
  misc_feature (298): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattatggtgtaaccaaaggagttaaggaactagtcgtgggggagaaaccgcgagttgtcccaaaaaccaggagatgggcagaaaatatacgagattgacccaacgctgaaagnttttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8732 - DNA, 453 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcactgatggtgtaaccaaaggagttaaggaactagtcgtgggggagaaaccgcgagttgtcccaaaaaccaggagatgggcagaaaatatacgagattgacccaacgctagaaagattttcggagccatcttgactaccggtaatgcctacccgctactttcgctcattttgaattaaggtcctttcgtcatgcaaatttgggaacatcaaagagacaaagactagggaccactattcttacagttcccctcatggtctgagaatatgctggga

SEQ ID NO: 8733 - DNA, 386 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaaaccgcgagttgtcccaaaaccaggagatgggcagaaaaatatacgagattgacccaacgctgaaagattttcggagccatcttgactaccggtaatgcctacccgctactttcgctcattttgaattaaggtcctttcgtcatgcaaaatttggggaacatcaaagagacaaagactagggaccactatttcttacagttcccctcatggtctgagaatatgctggga

SEQ ID NO: 8734 - DNA, 344 bp, Artificial; identical to SEQ ID NO: 7653
  TaSBEIIa allele with mutations introduced by TALEN pair TaSBEIIa_T02

SEQ ID NO: 8735 - DNA, 390 bp, Artificial; identical to SEQ ID NO: 7695
  TaSBEIIa allele with mutations introduced by TALEN pair TaSBEIIa_T02

SEQ ID NO: 8736 - DNA, 347 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagaaaccgcgagttgtcccaaaaccaggagatggggcagaaaatatacgagattgacccaacgctgaaagattttcggagccatcttagactaccggtaatgcctacccgctactttcgctcattttgaattaaggtcctttcgtcatgcaaatttggggaacatcaaagagacaaagactagggaccactatttcttacagttcccctctatggtctgagaatatgctggga

SEQ ID NO: 8737 - DNA, 459 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcatttgaattaaggtcctttcgtcatgcaaatttggggaacatcaaagagacaaagactagggaccactattcttacagttcccctcattggtctgagaatatgctgga

SEQ ID NO: 8738 - DNA, 454 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgaacaatcactgatggtgtaaccaaaggagttaaggaactagtcgtgggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaattgggaacatcaaagagacaaagactagggaccactatttcttacagttcccctcatggtctgagaatatgctgga

SEQ ID NO: 8739 - DNA, 421 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactagtcgtgggggagaaaccgcgagttgtcccaaaaccaggagatgggcagaaaatatacgagattgacccaacgctgaaagattttcggagccatcttgactaccggtaatgcctacccgctacttttcgctcattttgaattaaggtcctttcgtcatgcaaatttggggaacatcaaagagacaaagactagggaccactatttcttacagttcccctcatggtctgagaatatgctggga

SEQ ID NO: 8740 - DNA, 379 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattcttacagttcccctcatggtctgagaatatgctgga

SEQ ID NO: 8741 - DNA, 390 bp, Artificial; identical to SEQ ID NO: 7695
  TaSBEIIa allele with mutations introduced by TALEN pair TaSBEIIa_T02

SEQ ID NO: 8742 - DNA, 357 bp, Artificial; identical to SEQ ID NO: 7752
  TaSBEIIa allele with mutations introduced by TALEN pair TaSBEIIa_T02

SEQ ID NO: 8743 - DNA, 396 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacaaaggagttaaggaactagtcgcgggggagaaaccgcgagttgtcccaaaaccaggagatgggcagaaaatatacgagattgacccaacgctgaaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 8744 - DNA, 457 bp, Artificial; identical to SEQ ID NO: 7834
  TaSBEIIa allele with mutations introduced by TALEN pair TaSBEIIa_T02

SEQ ID NO: 8745 - DNA, 200 bp, Artificial; identical to SEQ ID NO: 7622
  TaSBEIIa allele with mutations introduced by TALEN pair TaSBEIIa_T02

SEQ ID NO: 8746 - DNA, 455 bp, Artificial
  TaSBEIIa allele with mutations introduced by TALEN pair TaSBEIIa_T02
  misc_feature (229): n is a or c or t or g
tcagatagatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaatcactgatggtgtaaccaaaggagttaaggaactagtcgtggggganaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattcttacagttccctcatggtctgagaatatgctggga

SEQ ID NO: 8747 - DNA, 457 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctaccgctactttcgctcattttgaattaaggtcctttcgtcatgcaaatttggggaacatcaaagagacaaagactagggaccactatttcttacagttcccctcatggtctgagaatatgctggga

SEQ ID NO: 8748 - DNA, 347 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaatatacgagattgacccaacgctgaaagattttcggagccatcttgactaccggtaatgcctacccgctactttcgctcattttgaatttaaggtcctttcgtcatgcaaatttggggaacatcaaagagacaaagactagggaccactatttcttacagttcccctcatggtctgagaatatgctggga

SEQ ID NO: 8749 - DNA, 448 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcggaaacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctaccgctacttcgctcattttgaattaaggtcctttcgtcatgcaaatttggggaacatcaaagagacaaagactagggaccactatttcttacagttccctcatggtctgagatatgctggga

SEQ ID NO: 8750 - DNA, 450 bp, Artificial
  TaSBEIIa allele with mutations introduced by TALEN pair TaSBEIIa_T02
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaacaatcactgatggtgtaaccaaaggagttaaggaactagtcgtgggggagaaaccgcgagttgtcccaaaaccaggagatgggcagaaaatatacgagattgacccaacactgaaagattttcggagccatcttgactaccggtaatgcctaccgctgctttcgctcattttgaattaaggtcctttcatcatgcaaatttggggaacatcaaagagacaaagactagggaccaccatttcatacagatccctcgtggtctgagatatgctggga

SEQ ID NO: 8751 - DNA, 460 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcaatcactgatggtgtaaccaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaattttggggaacatcaaagagacaaagactagggaccactattcttacagttccctcatggtctgagaatatgctggga

SEQ ID NO: 8752 - DNA, 459 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattcttacagttccctcatggtctgagaatatgctggga

SEQ ID NO: 8753 - DNA, 461 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcattgctaaatttggggaacatcaaagagacaaagactagggaccactatttcttacagttcccctcatggtctgagaatatgctggga

SEQ ID NO: 8754 - DNA, 458 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcacaatcactgatggtgtaaccaaaggagttaaggaactagtcgtgggggagaaaccgcgagttgtcccaaaaaccaggagatgggcagaaaatatacgagattgacccaacgctgaaagattttcggagccatcttgactactggtaatgcctacccgctactttcgctcattttgaattaaggtcctttcgtcatgcaaatttgggaacatcaaagagacaaagactaggaccactatttcttacagttcccctcatggtctgagaatatgctggga

SEQ ID NO: 8755 - DNA, 450 bp, Artificial; identical to SEQ ID NO: 8009
  TaSBEIIa allele with mutations introduced by TALEN pair TaSBEIIa_T02

SEQ ID NO: 8756 - DNA, 458 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggtgtaaccaaaggagttaaggaactagtcgtgggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8757 - DNA, 400 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaactagtcgtgggggagaaaccgcgagttgtcccaaaaccaggagatgggcagaaaatatacgagattgacccaacgctgaaagatttcggagccatcttgactaccggtaatgcctacccgctactttcgctcattttgaattaaggtcctttcgttatgcaaatttggggaacatcaaagagacaaagactagggaccactatttcttacagttcccctcatggtctgagaatatgctggga

SEQ ID NO: 8758 - DNA, 422 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggggactgcagaaaaacttgaatcttcagaaccgactagtcgtggggggagaaaccgcgagttgtcccaaaaaccaggagatgggcagaaaatatacgagattgacccaacgctgaaagattttcggagccatcttgactaccggtaatgcctacccgctactttcgctcattttgattaaggtcctttcgtcatgcaaatttggggaacatcaaagagacaaagactagggaccactatttcttacagttcccctcatggtctgagaatatgctggga

SEQ ID NO: 8759 - DNA, 466 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcaaacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 8760 - DNA, 440 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaaacttgaatcttcagaaccgactcaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtccttttcgtcatgcaaatttggggaacatcaaagagacaaagactagggaccactatttcttacagttcccctcatggtctgagaatatgctggga

SEQ ID NO: 8761 - DNA, 385 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacacgttcccctcatggtctgagaatatgctggga

SEQ ID NO: 8762 - DNA, 455 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcggtgtaaccaaaggagttaaggaactagtcgtggggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaagtttggggaacatcaaagagacaaagactagggaccactattcttacacgttcccctcatggtctgagaatatgctggga

SEQ ID NO: 8763 - DNA, 455 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactactggtaatgcctacccgctactttcgctcatttgaattaaggtccttcgtcatgcaaatttggggaacatcaaagagacaaagactagggaccactattcttacagttccctcatggtctgagaatatgctggga

SEQ ID NO: 8764 - DNA, 488 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaaggtcctggtgcctgacggcgagagcgacgacttggcaagtccggcgcaacctgaagaattacaggtacacacactcgtgccggtaaaatcttcatacaatcgttattcacttaccaaatgccggatgaaaaccaccacggatgcgtcaggtttcgagcttcttctatcagcattgtgcagtactgcactgccttgttcattttgttagccttggccccgtgctggctcttgggccactgaa

SEQ ID NO: 8765 - DNA, 442 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggtttgagcttcttctatcagcattgtgcagtactgcactgccttgtgcattttgtagccgtggccccgtgctggctcgttgggccacgtgaa

SEQ ID NO: 8766 - DNA, 487 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 8767 - DNA, 470 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 8768 - DNA, 482 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccgtcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 8769 - DNA, 434 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatatttctcactctttcttctgttcttgctgtaactgcaagttgtagcattgtctcactattgtagtcatccttgcattttgcaggcgccgtcctgagccgcgcggcctctccgtcctggtgcctgacggcgagagcgacgacttggcaagtccggcgcaacctgaagaattacaggtacacacactcgtgccggtaaatcttcatacaatcgttattcacttaccaaatgccggatgaaaccacacggatgcgtcaggtttcagcttctctatcagcattgtgcagtactgcactgccttgttcattttgtagccttggccccgtgctggctcttgggccactgaa

SEQ ID NO: 8770 - DNA, 486 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaaccaaccacggatgcgtcaggtttcgagcttcttctatcagcattgtgcagtactgcactgccttgttcattttgttagccttggccccgtgctggctcttgggccactgaa

SEQ ID NO: 8771 - DNA, 441 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggtttgagcttcttctatcagcattgtgcagtactgcactgccttgtgcattttgttagccgtggccccgtgctggctcttgggccactgaa

SEQ ID NO: 8772 - DNA, 463 bp, Artificial
  TaSBEIIa allele with mutations introduced by TALEN pair TaSBEIIa_T03
gagagatagctggattaggcgatcgcgcttcctgaacctgtatttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 8773 - DNA, 441 bp, Artificial; identical to SEQ ID NO: 8771
  TaSBEIIa allele with mutations introduced by TALEN pair TaSBEIIa_T03

SEQ ID NO: 8774 - DNA, 465 bp, Artificial
  TaSBEIIa allele with mutations introduced by TALEN pair TaSBEIIa_T03
gagagatagctggattaggcgatcgcgcttcctgaacctgtatttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgtagccttggccccgtgctggctcttgggccactgaa

SEQ ID NO: 8775 - DNA, 439 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatatttctcactctttcttctgttcttgctgtaactgcaagttgtagcattgtctcactattgtagtcatccttgcattgcaggcgccgtcctgagccgcgcggcctctccaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggtttgagcttcttctatcagcattgtgcagtactgcactgccttgtgcattttgtagccgtggccccgtgctggctcttgggccactgaa

SEQ ID NO: 8776 - DNA, 456 bp, Artificial
  TaSBEIIa allele with mutations introduced by TALEN pair TaSBEIIa_T03
gagagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 8777 - DNA, 483 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtccctggtgcctgacggcgagagcgacgacttggcaagtccggcgcaaacctgaagaattacaggtacacacactcgtgccggtaaatcttcatacaatcgtatcacttaccaaatgccggatgaaaccaccacggatgcgtcaggtttcgagcttcttctatcagcattgtgcagtactgcactgccttgttcatttgttagccttggccccgtgctggctcttgggccactgaa

SEQ ID NO: 8778 - DNA, 482 bp, Artificial
  TaSBEIIa allele with mutations introduced by TALEN pair TaSBEIIa_T03
gagagatagctggattaggcgatcgcgcttcctgaacctgtatttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcagtttcgagcttcttctatcagcattgtgcagtactgcactgccttgttcattttgttagccttggccccgtgctggctcttggccactgaa

SEQ ID NO: 8779 - DNA, 486 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 8780 - DNA, 490 bp, Artificial
  TaSBEIIa allele with mutations introduced by TALEN pair TaSBEIIa_T03
gagagatagctggattaggcgatcgcgcttcctgaacctgttattttttccccgcggggaaatgcgttagtgtcacccaggccctggtgttaccacggctttgatcattcctcgtttcattctgatatatattttctcactctttttcttcctgttcttgctgtaactgcaagttgtggtcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagtccttggccccgtgctggctcttgggccactgaa

SEQ ID NO: 8781 - DNA, 456 bp, Artificial
  TaSBEIIa allele with mutations introduced by TALEN pair TaSBEIIa_T03
gagagatagctggattaggcgatcgcgcttcctgaacctgtatttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctcttcgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatccagcattgtgcagtactgcactgccttgttcattttgttagccttggccccgtgctggctcttgggccactgaa

SEQ ID NO: 8782 - DNA, 485 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 8783 - DNA, 488 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaacccaaccacggatgcgtcaggtttcgagcttcttctatcagcattgtgcagtactgcactgccttgttcattttgttagccttggccccgtgctggctcttgggccactgaa

SEQ ID NO: 8784 - DNA, 481 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 8785 - DNA, 484 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgcctgttcattttgtagccttggccccgtgctggctcttgggccactgaa

SEQ ID NO: 8786 - DNA, 440 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctcaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggtttgagcttcttctatcagcattgtgcagtactgcactgccttgtgcattttgttagccgtggccccgtgctggctcgttgggccactgaa

SEQ ID NO: 8787 - DNA, 509 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggcgatggccaccacctgctccggggtcaagccgtgggaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgtagccttggccccgtgctggt

SEQ ID NO: 8788 - DNA, 481 bp, Artificial
  TaSBEIIa allele with mutations introduced by TALEN pair TaSBEIIa_T03
gagagatagctggattaggcgatcgcgcttcctgaacctgtatttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccgtcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 8789 - DNA, 480 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 8790 - DNA, 485 bp, Artificial; identical to SEQ ID NO: 8782
  TaSBEIIa allele with mutations introduced by TALEN pair TaSBEIIa_T03

SEQ ID NO: 8791 - DNA, 484 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 8792 - DNA, 485 bp, Artificial
  TaSBEIIa allele with mutations introduced by TALEN pair TaSBEIIa_T03
gagagatagctggattaggcgatcgcgcttcctgaacctgtatttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 8793 - DNA, 486 bp, Artificial; identical to SEQ ID NO: 8779
  TaSBEIIa allele with mutations introduced by TALEN pair TaSBEIIa_T03

SEQ ID NO: 8794 - DNA, 482 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttatcacttaccaaatgccggatgaaaccacacggatgcgtcaggtttcgagcttcttctatcagcattgtgcagtactgcactgccttgttcattttgtagccttggccccgtgctggctcttgggccactgaa

SEQ ID NO: 8795 - DNA, 435 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctcgtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtgcccgtgctggctcttgggccactgaa

SEQ ID NO: 8796 - DNA, 488 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaaggtcctggtgcctgacggcgagagcgacgacttggcaagtccggcgcaaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 8797 - DNA, 484 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctttgggccactga

SEQ ID NO: 8798 - DNA, 451 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagcctttggccccgtgctggctcttgggccactgaa

SEQ ID NO: 8799 - DNA, 486 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcaaggtcctggtgcctgacggcgagagcgacgacttggcaagtccggcgcaacctgaagaattacaggtacacacactcgtgccggtaaatcttcatacaatcgttattcacttaccaaatgccggatgaaaaccaaccacggatgcgtcaggtttcgagcttcttctatcagcattgtgcagtactgcactgccttgttcattttgttagccttggccccgtgctggctcttgggccactgaa

SEQ ID NO: 8800 - DNA, 486 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 8801 - DNA, 445 bp, Artificial
  TaSBEIIa allele with mutations introduced by TALEN pair TaSBEIIa_T03
  misc_feature (370): n is a or c or t or g
gagagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcattttgcaggcgccgtcctgagccgcgcggcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctntcagcattgtgcagtactgcactgccttgttcattttgttagccttggccccgtgctggctcttgggccactgaa

SEQ ID NO: 8802 - DNA, 477 bp, Artificial
  TaSBEIIa allele with mutations introduced by TALEN pair TaSBEIIa_T03
gagagatagctggattaggcgatcgcgcttcctgaacctgtattttttcccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctcttcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgtcattttgtagtccttggccccgtgctggctcttgggccactgaa

SEQ ID NO: 8803 - DNA, 486 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccggtcctggtgcctgacggcgagagcgacgacttggcaagtccggcgcaacctgaagaattacaggtacacacactcgtgccggtaaatcttcatacaatcgttattcacttaccaaatgccggatgaaaaccaaccacggatgcgtcaggtttcgagcttcttctatcagcattgtgcagtactgcactgccttgttcattttgtagtccttggccccgtgcctggctcttgggccactgaa

SEQ ID NO: 8804 - DNA, 485 bp, Artificial; identical to SEQ ID NO: 8782
  TaSBEIIa allele with mutations introduced by TALEN pair TaSBEIIa_T03

SEQ ID NO: 8805 - DNA, 482 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcatttgttagccttggccccgtgctggctcttgggccactgaa

SEQ ID NO: 8806 - DNA, 487 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagccttggccccgtgctggctcttgggccactgaa

SEQ ID NO: 8807 - DNA, 485 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 8808 - DNA, 442 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaaggtcctggtgcctgacggtgagagcgacgacttggcaagtccggcgcaacctgaagaattacaggtacacaccatcgtgccgggaaatctcatacaatcgttattcacttaccaaatgccggatgaaaccaagccgcggaggcgtcaggttttgagcttcttctatcagcattgtgcagtactgcactgccttgtgcattttgttagccgtggccccgtgctggctcgttgggccactgaa

SEQ ID NO: 8809 - DNA, 486 bp, Artificial; identical to SEQ ID NO: 8779
  TaSBEIIa allele with mutations introduced by TALEN pair TaSBEIIa_T03

SEQ ID NO: 8810 - DNA, 483 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctcaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 8811 - DNA, 486 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaaatcttcatacaatcgttattcacttaccaaatgccggatgaaaccaaccacggatgcgtcaggtttcgagcttcttctatcagcattgtgcagtactgcactgccttgttcatttgttagccttggccccgtgctggctcttgggccactgaa

SEQ ID NO: 8812 - DNA, 483 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggcccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaaggtcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttctctatcagcattgtgcagtactgcactgcctgttcatttgtagccttggccccgtgctggctcttgggccactgaa

SEQ ID NO: 8813 - DNA, 485 bp, Artificial
  TaSBEIIa allele with mutations introduced by TALEN pair TaSBEIIa_T03
gagagatagctggattaggcgatcgcgcttcctgaacctgtatttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaaatcttcatacaatcgttattcacttaccaaatgccggatgaaaaccaaccacggatgcgtcaggtttcgagcttcttctatcagcattgtgcagtactgcactgccttgttcattttgtagccttggccccgtgctggctcttgggccactgaa

SEQ ID NO: 8814 - DNA, 485 bp, Artificial; identical to SEQ ID NO: 8782
  TaSBEIIa allele with mutations introduced by TALEN pair TaSBEIIa_T03

SEQ ID NO: 8815 - DNA, 489 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaaatcttcatacaatcgttattcacttaccaaatgccggatgaaaaccaaccacggatgcgtcaggtttcgagcttcttctatcagcattgtgcagtactgcactgccttgttcattttgttagccttggccccgtgctgggctcttgggccactgaa

SEQ ID NO: 8816 - DNA, 443 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgaggcttcttctatcagcattgtgcagtactgcactgccttgtgcattttgtagccgtggccccgtgctgggctcttgggccactgaa

SEQ ID NO: 8817 - DNA, 462 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgtagccttggcccctgctggctcttgggccactgaa

SEQ ID NO: 8818 - DNA, 486 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 8819 - DNA, 486 bp, Artificial; identical to SEQ ID NO: 8779
  TaSBEIIa allele with mutations introduced by TALEN pair TaSBEIIa_T03

SEQ ID NO: 8820 - DNA, 485 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggtcctggtgcctgacggcgagagcgacgacttggcaagtccggcgcaacctgaagaattacaggtacacacactcgtgccggtaaatcttcatacaatcgttatcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 8821 - DNA, 485 bp, Artificial; identical to SEQ ID NO: 8782
  TaSBEIIa allele with mutations introduced by TALEN pair TaSBEIIa_T03

SEQ ID NO: 8822 - DNA, 487 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 8823 - DNA, 481 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctttggtcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 8824 - DNA, 468 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 8825 - DNA, 485 bp, Artificial; identical to SEQ ID NO: 8782
  TaSBEIIa allele with mutations introduced by TALEN pair TaSBEIIa_T03

SEQ ID NO: 8826 - DNA, 480 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggccaaggtcctggtgcctgacggcgagagcgacgacttggcaagtccggcgcaacctgaagaattacaggtacacacactcgtgccggtaaatcttcatacaatcgtattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 8827 - DNA, 487 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggtccctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 8828 - DNA, 484 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcaaggtcctggtgcctgacggcgagagcgacgacttggcaagtccggcgcaacctgaagaattacaggtacacacactcgtgccggtaaaatcttcatacaatcgttattcacttaccaaatgccggatgaaaccaaccacggatgcgtcaggtttcgagcttcttctatcagcattgtgcagtactgcactgccttgtcatttgttagccttggccccgtgctggctcttgggccactgaa

SEQ ID NO: 8829 - DNA, 486 bp, Artificial; identical to SEQ ID NO: 8779
  TaSBEIIa allele with mutations introduced by TALEN pair TaSBEIIa_T03

SEQ ID NO: 8830 - DNA, 481 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcgtcctggtgcctgacggcgagagcgacgacttggcaagtccggcgcaacctgaagaattacaggtacacacactcgtgccggtaaatcttcatacaatcgttattcacttaccaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 8831 - DNA, 422 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttgttagccgtggccccgtgctggctcttgggccactgaa

SEQ ID NO: 8832 - DNA, 485 bp, Artificial; identical to SEQ ID NO: 8782
  TaSBEIIa allele with mutations introduced by TALEN pair TaSBEIIa_T03

SEQ ID NO: 8833 - DNA, 481 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccgtcctggtgcctgacggcgagagcgacgacttggcaagtccggcgcaacctgaagaattacaggtacacacactcgtgccggtaaatcttcatacaatcgttatcacttaccaaatgccgatgaaaccaccacggatgcgtcaggtttcgagcttcttctatcagcattgtgcagtactgcactgccttgttctattttgtagtccttggccccgtgctggctcttgggccactgaa

SEQ ID NO: 8834 - DNA, 475 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgcctggctcttgggccactgaa

SEQ ID NO: 8835 - DNA, 481 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctgtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 8836 - DNA, 483 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 8837 - DNA, 486 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaaggtcctggtgcctgacggcgagagcgacgacttggcaagtccggcgcaacctgaagaattacaggtacacacactcgtgccggtaaatcttcatacaatcgtattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 8838 - DNA, 477 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccatacagcgtgagctatgagaaagcgccacgcttcccgaagggagaaaggcggaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctt

SEQ ID NO: 8839 - DNA, 486 bp, Artificial; identical to SEQ ID NO: 8779
  TaSBEIIa allele with mutations introduced by TALEN pair TaSBEIIa_T03

SEQ ID NO: 8840 - DNA, 483 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcatttgttagccttggccccgtgctggctcttgggccactgaa

SEQ ID NO: 8841 - DNA, 470 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 8842 - DNA, 479 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 8843 - DNA, 485 bp, Artificial; identical to SEQ ID NO: 8782
  TaSBEIIa allele with mutations introduced by TALEN pair TaSBEIIa_T03

SEQ ID NO: 8844 - DNA, 486 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaaggtcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 8845 - DNA, 484 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 8846 - DNA, 485 bp, Artificial; identical to SEQ ID NO: 8782
  TaSBEIIa allele with mutations introduced by TALEN pair TaSBEIIa_T03

SEQ ID NO: 8847 - DNA, 452 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcgcgacgacttggcaagtccggcgcaacctgaagaattacaggtacacacactcgtgccggtaaatcttcatacaatcgttattcacttaccaatgccggatgaaaccaccacggatgcgtcaggtttcgagcttcttctatcagcattgtgcagtactgcactgccttgttcattttgtagccttggccccgtgctggctcttgggccactgaa

SEQ ID NO: 8848 - DNA, 489 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccagtttttgacggtgttttccgcgttaccagcagcgttaacggtgatggtaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggcctacg

SEQ ID NO: 8849 - DNA, 486 bp, Artificial; identical to SEQ ID NO: 8770
  TaSBEIIa allele with mutations introduced by TALEN pair TaSBEIIa_T03

SEQ ID NO: 8850 - DNA, 486 bp, Artificial; identical to SEQ ID NO: 8800
  TaSBEIIa allele with mutations introduced by TALEN pair TaSBEIIa_T03

SEQ ID NO: 8851 - DNA, 425 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgtagccgtggccccgtgctggctcgttgggccactgaa

SEQ ID NO: 8852 - DNA, 432 bp, Artificial
  TaSBEIIa allele with mutations introduced by TALEN pair TaSBEIIa_T03
gagagatagctggattaggcgatcgcctcaggccctggtgttaccacggctttgatcatctcctcctttcatgctgatattttctcactctttcttctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 8853 - DNA, 486 bp, Artificial; identical to SEQ ID NO: 8779
  TaSBEIIa allele with mutations introduced by TALEN pair TaSBEIIa_T03

SEQ ID NO: 8854 - DNA, 473 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctggtgcctgacggcgagagcgacgacttggcaagtccggcgcaacctgaagaattacaggtacacacactcgtgccggtaaatcttcatacaatcgttattcacttaccaaatgtcggatgaaaccaaccacggatgcgtcaggtttcgagcttcttctatcagcattgtgcagtactgcactgccttgttcattttgttagccttggccccgtgctggctcttgggccactga

SEQ ID NO: 8855 - DNA, 485 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaacacggatgcgtcaggtttcgagcttcttctatcagcattgtgcagtactgcactgccttgttcattttgttagccttggccccgtgctggctcttgggccactgaa

SEQ ID NO: 8856 - DNA, 485 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagtcctggtgcctgacggcgagagcgacgacttggcaagtccggcgcaacctgaagaattacaggtacacacactcgtgccggtaaatcttcatacaatcgttattcacttaccaaatgccggatgaaaaccaaccacggatgcgtcaggtttcgagcttcttctatcagcattgtgcagtactgcactgccttgttcattttgttagccttggccccgtgctggctcttgggccactgaa

SEQ ID NO: 8857 - DNA, 487 bp, Artificial; identical to SEQ ID NO: 8822
  TaSBEIIa allele with mutations introduced by TALEN pair TaSBEIIa_T03

SEQ ID NO: 8858 - DNA, 510 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggggtcataacgtgactcccttaattctccgctcatgatcattggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccggttg

SEQ ID NO: 8859 - DNA, 486 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatggaaaccaaccacggatgcgtcaggtttcgagcttcttctatcagcattgtgcagtactgcactgccttgttcattttgttagccttggccccgtgctggctcttgggccactgaa

SEQ ID NO: 8860 - DNA, 486 bp, Artificial; identical to SEQ ID NO: 8779
  TaSBEIIa allele with mutations introduced by TALEN pair TaSBEIIa_T03

SEQ ID NO: 8861 - DNA, 486 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagtccttggccccgtgctggctcttgggccactgaa

SEQ ID NO: 8862 - DNA, 485 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgtagccttggccccgtgctggctcttgggccactgaa

SEQ ID NO: 8863 - DNA, 486 bp, Artificial; identical to SEQ ID NO: 8779
  TaSBEIIa allele with mutations introduced by TALEN pair TaSBEIIa_T03

SEQ ID NO: 8864 - DNA, 440 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggtttgagcttcttctatcagcattgtgcagtactgcactgccttgtgctattttgtagccgtggccccgtgctggctctgggccactgaa

SEQ ID NO: 8865 - DNA, 486 bp, Artificial; identical to SEQ ID NO: 8779
  TaSBEIIa allele with mutations introduced by TALEN pair TaSBEIIa_T03

SEQ ID NO: 8866 - DNA, 471 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggtcgttttttcactattgtagtcatccttgcattttgcaggcgccgtcctgagccgtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 8867 - DNA, 484 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 8868 - DNA, 442 bp, Artificial
  TaSBEIIa allele with mutations introduced by TALEN pair TaSBEIIa_T03
  misc_feature (25): n is a or c or t or g
gagagatagctggattaggcgatcncctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 8869 - DNA, 485 bp, Artificial; identical to SEQ ID NO: 8782
  TaSBEIIa allele with mutations introduced by TALEN pair TaSBEIIa_T03

SEQ ID NO: 8870 - DNA, 454 bp, Artificial
  TaSBEIIa allele with mutations introduced by TALEN pair TaSBEIIa_T03
gagagatagctggattaggcgatcgcgcttcctgaacctgtattttttcccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctcttcgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 8871 - DNA, 485 bp, Artificial; identical to SEQ ID NO: 8862
  TaSBEIIa allele with mutations introduced by TALEN pair TaSBEIIa_T03

SEQ ID NO: 8872 - DNA, 441 bp, Artificial; identical to SEQ ID NO: 8771
  TaSBEIIa allele with mutations introduced by TALEN pair TaSBEIIa_T03

SEQ ID NO: 8873 - DNA, 484 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgtagccttggccccgtgctggctcttgggccactgaa

SEQ ID NO: 8874 - DNA, 424 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctctgagagcgacgacttgggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgtagccgtggccccgtgctggctcgttgggccacgtgaa

SEQ ID NO: 8875 - DNA, 486 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaaccaaccacggatgcgtcaggtttcgagcttcttctatcagcattgtgcagtactgcactgccttgttcatttgttagccttggccccgtgctggctcttgggccactgaa

SEQ ID NO: 8876 - DNA, 499 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggcgatggccaccacctgctccggggtcaagccgtgggaaggtcctggtgcctgacggcgagagcgacgacttggcaagtccggcgcaacctgaagaattacaggtacacacactcgtgccggtaaaatcttcatacaatcgttattcacttaccaaatgccggatgaaaccaaccacggatgcgtcaggtttcgagcttcttctatcagcattgtgcagtactgcactgccttgttcattttgttagccttgg

SEQ ID NO: 8877 - DNA, 485 bp, Artificial; identical to SEQ ID NO: 8782
  TaSBEIIa allele with mutations introduced by TALEN pair TaSBEIIa_T03

SEQ ID NO: 8878 - DNA, 465 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 8879 - DNA, 484 bp, Artificial
  TaSBEIIa allele with mutations introduced by TALEN pair TaSBEIIa_T03
gaggatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 8880 - DNA, 464 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 8881 - DNA, 484 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcaggtcctggtgcctgacggcgagagcgacgacttggcaagtccggcgcaacctgaagaattacaggtacacacactcgtgccggtaaatcttcatacaatcgttatcacttaccaaatgccggatgaaaccaaccacggatgcgtcaggtttcgagcttcttctatcagcattgtgcagtactgcactgccttgttctattttgtagtccttggccccgtgctggctcttgggccactgaa

SEQ ID NO: 8882 - DNA, 485 bp, Artificial; identical to SEQ ID NO: 8782
  TaSBEIIa allele with mutations introduced by TALEN pair TaSBEIIa_T03

SEQ ID NO: 8883 - DNA, 484 bp, Artificial; identical to SEQ ID NO: 8867
  TaSBEIIa allele with mutations introduced by TALEN pair TaSBEIIa_T03

SEQ ID NO: 8884 - DNA, 487 bp, Artificial; identical to SEQ ID NO: 8822
  TaSBEIIa allele with mutations introduced by TALEN pair TaSBEIIa_T03

SEQ ID NO: 8885 - DNA, 479 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctgtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 8886 - DNA, 484 bp, Artificial; identical to SEQ ID NO: 8867
  TaSBEIIa allele with mutations introduced by TALEN pair TaSBEIIa_T03

SEQ ID NO: 8887 - DNA, 486 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagccttggccccgtgctggctcttgggccactgaa

SEQ ID NO: 8888 - DNA, 471 bp, Artificial
  TaSBEIIa allele with mutations introduced by TALEN pair TaSBEIIa_T03
  misc_feature (368): n is a or c or t or g
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctggtgcctgacggcgagagcgacgacttggcaagtccggcgcaacctgaagaattacaggtacacacactcgtgccggtaaatcttcatacaatcgttattcacttaccaatgccggatgaaaccaccncggatgcgtcaggtttcgagcttcttctatcagcattgtgcagtactgcactgccttgttcattttgtagccttggccccgtgctggctcttgggccactgaa

SEQ ID NO: 8889 - DNA, 478 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 8890 - DNA, 439 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctcgtccctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 8891 - DNA, 422 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggtttgagcttcttctatcagcattgtgcagtactgcactgccttgtgcattttgttagccgtggccccgtgctggctcttgggccactgaa

SEQ ID NO: 8892 - DNA, 480 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 8893 - DNA, 485 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctctggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgttgctggctcttgggccactgaa

SEQ ID NO: 8894 - DNA, 484 bp, Artificial; identical to SEQ ID NO: 8867
  TaSBEIIa allele with mutations introduced by TALEN pair TaSBEIIa_T03

SEQ ID NO: 8895 - DNA, 483 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccgtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 8896 - DNA, 486 bp, Artificial; identical to SEQ ID NO: 8861
  TaSBEIIa allele with mutations introduced by TALEN pair TaSBEIIa_T03

SEQ ID NO: 8897 - DNA, 449 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcgacttggcaagtccggcgcaacctgaagaattacaggtacacacactcgtgccggtaaatcttcatacaatcgttattcacttaccaaatgccggatgaaaccaccacggatgcgtcaggtttcgagcttctctatcagcattgtgcagtactgcactgccttgttctattttgttagccttggccccgtgctggctcttgggccactgaa

SEQ ID NO: 8898 - DNA, 482 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcgtcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggcccccgtgctggctcttgggccactgaa

SEQ ID NO: 8899 - DNA, 488 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccagtttttgacggtgttttccgcgttaccagcagcgttaacggtgatggtaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggtttgagcttcttctatcagcattgtgcagtactgcactgccttgtgcattttgttagccgtggccccgtgctggctcttgggcctacg

SEQ ID NO: 8900 - DNA, 483 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttacaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 8901 - DNA, 484 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgtcattttgttagccttggccccgtgctggctcttgggccactgaa

SEQ ID NO: 8902 - DNA, 482 bp, Artificial
  TaSBEIIa allele with mutations introduced by TALEN pair TaSBEIIa_T03
gagagatagctggattaggcgatcgcgcttcctgaacctgtatttttcccgcgggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtccctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgtagccttggccccgtgctggctcttgggccactgaa

SEQ ID NO: 8903 - DNA, 485 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 8904 - DNA, 502 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccatttcgtgtcgcgcgtttcggtgatgacggtgaaaacctctgacacatgcagctcccggacacggtcacagcttgtctgtaaggtcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgc

SEQ ID NO: 8905 - DNA, 473 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcgtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggttcgagcttcttctatcagcattgtgcagtactgcactgccttgttcattttgttagccttggccccgtgctggctcttgggcactga

SEQ ID NO: 8906 - DNA, 485 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccctgaa

SEQ ID NO: 8907 - DNA, 470 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 8908 - DNA, 486 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcaaggtcctggtgcctgacggcgagagcgacgacttggcaagtccggcgcaacctgaagaattacaggtacacacactcgtgccggtaaaatcttcatacaatcgttattcacttaccaaatgccggatgaaaaccaccacggatgcgtcaggtttcgagcttcttctatcagcatgtgcagtactgcactgccttgttcattttgttagccttggccccgtgcctggctcttgggccactgaa

SEQ ID NO: 8909 - DNA, 485 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgtattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 8910 - DNA, 485 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaaccaaccacggatgcgtcaggtttcgagcttcttctatcagcattgtgcagtactgcactgccttgttcatttgtagccttggccccgtgctggctcttgggccactgaa

SEQ ID NO: 8911 - DNA, 487 bp, Artificial; identical to SEQ ID NO: 8766
  TaSBEIIa allele with mutations introduced by TALEN pair TaSBEIIa_T03

SEQ ID NO: 8912 - DNA, 487 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagtccttggccccgtgctggctcttgggccactgaa

SEQ ID NO: 8913 - DNA, 484 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttatcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 8914 - DNA, 465 bp, Artificial; identical to SEQ ID NO: 8878
  TaSBEIIa allele with mutations introduced by TALEN pair TaSBEIIa_T03

SEQ ID NO: 8915 - DNA, 486 bp, Artificial
  TaSBEIIa allele with mutations introduced by TALEN pair TaSBEIIa_T03
gagagatagctggattaggcgatcgcgcttcctgaacctgttattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 8916 - DNA, 478 bp, Artificial
  TaSBEIIa allele with mutations introduced by TALEN pair TaSBEIIa_T03
gagagatagctggattaggcgatcgcgcttcctgaacctgtatttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccgtcctggtgcctgacggcgagagcgacgacttggcaagtccggcgcaacctgaagaattacaggtacacacactcgtgccggtaaatcttcatacaatcgttatcacttaccaaatgccggatgaaaccacacggatgcgtcaggtttcgagcttcttctatcagcattgtgcagtactgcactgccttgttcatttgttagccttggccccgtgctggctcttgggccactgaa

SEQ ID NO: 8917 - DNA, 479 bp, Artificial; identical to SEQ ID NO: 8885
  TaSBEIIa allele with mutations introduced by TALEN pair TaSBEIIa_T03

SEQ ID NO: 8918 - DNA, 485 bp, Artificial
  TaSBEIIa allele with mutations introduced by TALEN pair TaSBEIIa_T03
gagagatagctggattaggcgatcgcgcttcctgaacctgtattttttcccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagtccttggccccgtgctggctcttgggccactga

SEQ ID NO: 8919 - DNA, 476 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcgtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 8920 - DNA, 485 bp, Artificial; identical to SEQ ID NO: 8782
  TaSBEIIa allele with mutations introduced by TALEN pair TaSBEIIa_T03

SEQ ID NO: 8921 - DNA, 485 bp, Artificial; identical to SEQ ID NO: 8782
  TaSBEIIa allele with mutations introduced by TALEN pair TaSBEIIa_T03

SEQ ID NO: 8922 - DNA, 488 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcacttattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgcccggatgaaaaccaaccacggatgcgtcaggtttcgagcttcttctatcagcattgtgcagtactgcactgccttgttcattttgttagccttggccccgtgctggctcttgggccactgaa

SEQ ID NO: 8923 - DNA, 485 bp, Artificial; identical to SEQ ID NO: 8782
  TaSBEIIa allele with mutations introduced by TALEN pair TaSBEIIa_T03

SEQ ID NO: 8924 - DNA, 483 bp, Artificial
  TaSBEIIa allele with mutations introduced by TALEN pair TaSBEIIa_T03
gagagatagctggattaggcgatcgcgcttcctgaacctgtattttttcccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttacaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 8925 - DNA, 484 bp, Artificial; identical to SEQ ID NO: 8845
  TaSBEIIa allele with mutations introduced by TALEN pair TaSBEIIa_T03

SEQ ID NO: 8926 - DNA, 486 bp, Artificial; identical to SEQ ID NO: 8779
  TaSBEIIa allele with mutations introduced by TALEN pair TaSBEIIa_T03

SEQ ID NO: 8927 - DNA, 483 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcgtcctggtgcctgacggcgagagcgacgacttggcaagtccggcgcaacctgaagaattacaggtacacacactcgtgccggtaaatcttcatacaatcgttattcacttaccaaatgccggatgaaaccaaccacgggatgcgtcaggtttcgagcttcttctatcagcattgtgcagtactgcactgccttgttcattttgttagccttggccccgtgctggctcttgggccactgaa

SEQ ID NO: 8928 - DNA, 480 bp, Artificial; identical to SEQ ID NO: 8892
  TaSBEIIa allele with mutations introduced by TALEN pair TaSBEIIa_T03

SEQ ID NO: 8929 - DNA, 487 bp, Artificial; identical to SEQ ID NO: 8822
  TaSBEIIa allele with mutations introduced by TALEN pair TaSBEIIa_T03

SEQ ID NO: 8930 - DNA, 492 bp, Artificial
  TaSBEIIa allele with mutations introduced by TALEN pair TaSBEIIa_T03
gagagatagctggattaagcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcccacggcttgaccccggagcaggtggtggccatcgccagccacgatggcggcaagcaggcgctggagacggaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagta

SEQ ID NO: 8931 - DNA, 487 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaaccaaccacggatgcgtcaggtttcgagcttcttctatcagcattgtgcagtactgcactgccttgttcattttgttagccttggccccgtgctggctcttgggccactgaa

SEQ ID NO: 8932 - DNA, 423 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 8933 - DNA, 439 bp, Artificial
  TaSBEIIa allele with mutations introduced by TALEN pair TaSBEIIa_T03
  misc_feature (392): n is a or c or t or g
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctcgtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggtttgagcttcttctatcagcattgtgcagtactgcactgccttgngcattttgtagccgtggccccgtgctgggctcgttggggccactgaa

SEQ ID NO: 8934 - DNA, 485 bp, Artificial; identical to SEQ ID NO: 8782
  TaSBEIIa allele with mutations introduced by TALEN pair TaSBEIIa_T03

SEQ ID NO: 8935 - DNA, 467 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcagcttcttctatcagcattgtgcagtactgcactgccttgttcattttgttagccttggccccgtgctggctcttgggccactgaa

SEQ ID NO: 8936 - DNA, 483 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctttggcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatctagcattgtgcagtactgcactgccttgttcattttgttagcctttggccccgtgctggctcttgggccactgaa

SEQ ID NO: 8937 - DNA, 487 bp, Artificial; identical to SEQ ID NO: 8931
  TaSBEIIa allele with mutations introduced by TALEN pair TaSBEIIa_T03

SEQ ID NO: 8938 - DNA, 458 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 8939 - DNA, 476 bp, Artificial; identical to SEQ ID NO: 8919
  TaSBEIIa allele with mutations introduced by TALEN pair TaSBEIIa_T03

SEQ ID NO: 8940 - DNA, 485 bp, Artificial; identical to SEQ ID NO: 8782
  TaSBEIIa allele with mutations introduced by TALEN pair TaSBEIIa_T03

SEQ ID NO: 8941 - DNA, 490 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcatgttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcttattttgtagtccgttggccccgtcgctggctcttgggccactgaa

SEQ ID NO: 8942 - DNA, 487 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaacttacaggtacacacactcgtgccggtaaatcttcatacaatcgttattcacttaccaaatgccggatgaaaccaccacggatgcgtcaggtttcgagcttcttctatcagcattgtgcagtactgcactgccttgttctattttgttagccttggccccgtgctggctcgttgggccactgaa

SEQ ID NO: 8943 - DNA, 485 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgtagccttggccccgtgctggctcttgggccactgaa

SEQ ID NO: 8944 - DNA, 489 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccagtttttgacggtgttttccgcgttaccagcagcgttaacggtgatggtaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcagggttttgagcttcttctatcagcattgtgcagtactgcactgccttgtgcattttgtagccgtggccccgtgctggctcttgggcctacg

SEQ ID NO: 8945 - DNA, 486 bp, Artificial; identical to SEQ ID NO: 8861
  TaSBEIIa allele with mutations introduced by TALEN pair TaSBEIIa_T03

SEQ ID NO: 8946 - DNA, 485 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttcgggccactgaa

SEQ ID NO: 8947 - DNA, 487 bp, Artificial; identical to SEQ ID NO: 8912
  TaSBEIIa allele with mutations introduced by TALEN pair TaSBEIIa_T03

SEQ ID NO: 8948 - DNA, 486 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 8949 - DNA, 495 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagcctcgcgaatgcatctagatccaatgatcatgagcggagaattaagggaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctt

SEQ ID NO: 8950 - DNA, 485 bp, Artificial; identical to SEQ ID NO: 8782
  TaSBEIIa allele with mutations introduced by TALEN pair TaSBEIIa_T03

SEQ ID NO: 8951 - DNA, 484 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctcaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagtccttggccccgtgctggctcttgggccactgaa

SEQ ID NO: 8952 - DNA, 491 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcccacggcttgaccccggagcaggtggtggccatcgccagccacgatggcggcaagcaggcgctggagacggaaggtcctggtgcctgacggcgagagcgacgacttggcaagtccggcgcaacctgaagaattacaggtacacacactcgtgccggtaaatcttcatacaatcgttattcacttaccaatgccggatgaaaccaaccacggatgcgtcaggtttcgagcttcttctatcagcattgtgcagta

SEQ ID NO: 8953 - DNA, 485 bp, Artificial; identical to SEQ ID NO: 8782
  TaSBEIIa allele with mutations introduced by TALEN pair TaSBEIIa_T03

SEQ ID NO: 8954 - DNA, 485 bp, Artificial; identical to SEQ ID NO: 8782
  TaSBEIIa allele with mutations introduced by TALEN pair TaSBEIIa_T03

SEQ ID NO: 8955 - DNA, 482 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctgtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagtccttggccccgtgctggctcttgggccactgaa

SEQ ID NO: 8956 - DNA, 487 bp, Artificial; identical to SEQ ID NO: 8931
  TaSBEIIa allele with mutations introduced by TALEN pair TaSBEIIa_T03

SEQ ID NO: 8957 - DNA, 480 bp, Artificial; identical to SEQ ID NO: 8892
  TaSBEIIa allele with mutations introduced by TALEN pair TaSBEIIa_T03

SEQ ID NO: 8958 - DNA, 488 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcaaaggtcctggtgcctgacggcgagagcgacgacttggcaagtccggcgcaacctgaagaattacaggtacacacactcgtgccggtaaaatcttcatacaatcgttattcacttaccaaatgccggatgaaaaccaaccacggatgcgtcaggtttcgagcttcttctatcagcattgtgcagtactgcactgccttgttcattttgttagccttggccccgtgctggctcttgggccactgaa

SEQ ID NO: 8959 - DNA, 488 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacgggatgcgtcaggtttcgagcttcttctatcagcattgtgcagtactgcactgccttgttcattttgttagccttggccccgttgctggctcttgggccactgaa

SEQ ID NO: 8960 - DNA, 487 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagtccttggccccgtgctggctcttgggccactgaa

SEQ ID NO: 8961 - DNA, 485 bp, Artificial
  TaSBEIIa allele with mutations introduced by TALEN pair TaSBEIIa_T03
gagagatagctggattaggcgatcgcgcttcctgaacctgttattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagtccttggccccgtgctggctcttgggccactgaa

SEQ ID NO: 8962 - DNA, 484 bp, Artificial; identical to SEQ ID NO: 8867
  TaSBEIIa allele with mutations introduced by TALEN pair TaSBEIIa_T03

SEQ ID NO: 8963 - DNA, 485 bp, Artificial; identical to SEQ ID NO: 8782
  TaSBEIIa allele with mutations introduced by TALEN pair TaSBEIIa_T03

SEQ ID NO: 8964 - DNA, 484 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcatttttgcaggcgccgtcctgagccgcgcggcctctccaggtcctggtgcctgacggcgagagcgacgacttggcaagtccggcgcaacctgaagattacaggtacacacactcgtgccggtaaatcttcatacaatcgtattcacttaccaaatgccggatgaaaaccaccacggatgcgtcaggtttcgagcttcttctatcagcattgtgcagtactgcactgccttgttcattttgttagccttggccccgtgctggctcttgggccactgaa

SEQ ID NO: 8965 - DNA, 484 bp, Artificial
  TaSBEIIa allele with mutations introduced by TALEN pair TaSBEIIa_T03
gagagatagctggattaggcgatcgcgcttcctgaacctgtatttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctctggtcctggtgcctgacggcgagagcgacgacttggcaagtccggcgcaaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 8966 - DNA, 478 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccatgcttccggctcgtatgttgtgtggaattgtgagcggataacaatttcacacaggaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagtccgttggtccccg

SEQ ID NO: 8967 - DNA, 487 bp, Artificial; identical to SEQ ID NO: 8931
  TaSBEIIa allele with mutations introduced by TALEN pair TaSBEIIa_T03

SEQ ID NO: 8968 - DNA, 450 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 8969 - DNA, 487 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttatcacttaccaaatgccggatgaaaccaaccacggatgcgtcaggtttcgagcttcttctatcagcattgtgcagtactgcactgccttgttctattttgttagtccttggccccgtgctggctcttgggccactgaa

SEQ ID NO: 8970 - DNA, 486 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttctattttgttagccttggccccgtgctggctcttgggccactgaa

SEQ ID NO: 8971 - DNA, 485 bp, Artificial; identical to SEQ ID NO: 8903
  TaSBEIIa allele with mutations introduced by TALEN pair TaSBEIIa_T03

SEQ ID NO: 8972 - DNA, 487 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcatttttgcaggcgccgtcctgagccgcgcggcctctctggtcctggtgcctgacggcgagagcgacgacttggcaagtccggcgcaaacctgaagaattacaggtacacacactcgtgccggtaaaatcttcatacaatcgttatcacttaccaaatgccggatgaaaaccaaccacggatgcgtcaggtttcgagcttcttctatcagcattgtgcagtactgcactgccttgttcatttgttagccttggccccgtgctgggctcttgggccactgaa

SEQ ID NO: 8973 - DNA, 484 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcatttgttagccttggccccgtgctggctcttgggccactgaa

SEQ ID NO: 8974 - DNA, 485 bp, Artificial; identical to SEQ ID NO: 8782
  TaSBEIIa allele with mutations introduced by TALEN pair TaSBEIIa_T03

SEQ ID NO: 8975 - DNA, 486 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggtcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagtccttggccccgtgctggctcttgggccactgaa

SEQ ID NO: 8976 - DNA, 441 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatatttctcactctttcttctgttcttgctgtaactgcaagttgtagcattgtctcactattgtagtcatccttgcattgcaggcgccgtcctgagccgcgcggcctctccaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccttggccccgtgctggctcttgggccactgaa

SEQ ID NO: 8977 - DNA, 485 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccggtcctggtgcctgacggcgagagcgacgacttggcaagtccggcgcaacctgaagaattacaggtacacacactcgtgccggtaaatcttcatacaatcgttattcacttaccaaatgccggatgaaaaccaaccacggatgcgtcaggtttcgagcttcttctatcagcattgtgcagtactgcactgccttgttcattttgttagccttggccccgtgctggctcttgggccactgaa

SEQ ID NO: 8978 - DNA, 443 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggtttgagcttcttctatcagcattgtgcagtactgcactgccttgtgctattttgtagccgtggccccgtgctggctcgttcgggccactgaa

SEQ ID NO: 8979 - DNA, 486 bp, Artificial; identical to SEQ ID NO: 8779
  TaSBEIIa allele with mutations introduced by TALEN pair TaSBEIIa_T03

SEQ ID NO: 8980 - DNA, 519 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaagattctccaaaaaaatcttcatggtaaccgtccctctcgaaggatgttttcagtatccggctaaaagggaaaggtcctggtgcctgacggcgagagcgacgacttggcaagtccggcgcaacctgaagaattacaggtacacacactcgtgccggtaaatcttcatacaatcgttatcacttaccaaatgccggatgaaaccaacacggatgcgtcaggtttcgagcttcttctatcagcattgtgcagtactgcactgccttgttcattttt

SEQ ID NO: 8981 - DNA, 486 bp, Artificial; identical to SEQ ID NO: 8770
  TaSBEIIa allele with mutations introduced by TALEN pair TaSBEIIa_T03

SEQ ID NO: 8982 - DNA, 480 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctgtcctggtgcctgacggcgagagcgacgacttggcaagtccggcgcaacctgaagaattacaggtacacacactcgtgccggtaaatcttcatacaatcgttattcacttaccaatgccggatgaaaccacacggatgcgtcaggtttcgagcttcttctatcagcattgtgcagtactgcactgccttgttcattttgttagtccttggccccgtgcctggctcttgggccactgaa

SEQ ID NO: 8983 - DNA, 482 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcaggtcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgtagccttggccccgtgctggctcttgggccactgaa

SEQ ID NO: 8984 - DNA, 486 bp, Artificial; identical to SEQ ID NO: 8779
  TaSBEIIa allele with mutations introduced by TALEN pair TaSBEIIa_T03

SEQ ID NO: 8985 - DNA, 484 bp, Artificial
  TaSBEIIa allele with mutations introduced by TALEN pair TaSBEIIa_T03
gagagatagctggattaggcgatcgcgcttcctgaacctgtattttttcccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 8986 - DNA, 465 bp, Artificial; identical to SEQ ID NO: 8878
  TaSBEIIa allele with mutations introduced by TALEN pair TaSBEIIa_T03

SEQ ID NO: 8987 - DNA, 470 bp, Artificial; identical to SEQ ID NO: 8767
  TaSBEIIa allele with mutations introduced by TALEN pair TaSBEIIa_T03

SEQ ID NO: 8988 - DNA, 438 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccgtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggtttgagcttcttctatcagcattgtgcagtactgcactgccttgtgcattttgttagccgtggccccgtgctggctcttgggccactgaa

SEQ ID NO: 8989 - DNA, 483 bp, Artificial; identical to SEQ ID NO: 8895
  TaSBEIIa allele with mutations introduced by TALEN pair TaSBEIIa_T03

SEQ ID NO: 8990 - DNA, 475 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggccctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 8991 - DNA, 489 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaaccaaccacggatgcgtcaggtttcgagcttcttctatcagcattgtgcagtactgcactgccttgttcattttgttagcctttggccccgttgctggctcttgggccactgaa

SEQ ID NO: 8992 - DNA, 484 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccggtcctggtgcctgacggcgagagcgacgacttggcaagtccggcgcaacctgaagaattacaggtacacacactcgtgccggtaaatcttcatacaatcgttattcacttaccaaatgtcggatgaaaccaaccacggatgcgtcaggtttcgagcttcttctatcagcattgtgcagtactgcactgccttgttcattttgttagccttggccccgtgctggctcttgggccactgaa

SEQ ID NO: 8993 - DNA, 478 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctgtcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 8994 - DNA, 485 bp, Artificial; identical to SEQ ID NO: 8782
  TaSBEIIa allele with mutations introduced by TALEN pair TaSBEIIa_T03

SEQ ID NO: 8995 - DNA, 509 bp, Artificial
  TaSBEIIa allele with mutations introduced by TALEN pair TaSBEIIa_T03
gagagatagctggattaggcgatcgcgcttcctgaacctgtattttttcccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagaagatcctttttgataatctcatgaccaaaatcccttaacgtgagttttcgttccactgagcgtcaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttt

SEQ ID NO: 8996 - DNA, 487 bp, Artificial
  TaSBEIIa allele with mutations introduced by TALEN pair TaSBEIIa_T03
gagagatagctggattaggcgatcgcgcttcctgaacctgtattttttcccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagtccttggccccgtgctggctcttgggccactgaa

SEQ ID NO: 8997 - DNA, 488 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatggaaaaccaaccacgggatgcgtcaggtttcgagcttcttctatcagcattgtgcagtactgcactgccttgttcattttgttagccttggccccgtgctggctcttgggccactgaa

SEQ ID NO: 8998 - DNA, 522 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaagattctccaaaaaaatcttcatggtaaccgtccctctcgaaggatgtttttcagtatccggctaaaagggaaaggtcctggtgcctgacggcgagagcgacgacttggcaagtccggcgcaacctgaagaattacaggtacacacactcgtgcccggtaaatcttcatacaatcgttattcacttaccaaatgccggatgaaaccacacggatgcgtcaggtttcgagcttcttctatcagcattgtgcagtactgcactgcctttgttcattttt

SEQ ID NO: 8999 - DNA, 488 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagtccttggcccccgtgctggctcttgggccactgaa

SEQ ID NO: 9000 - DNA, 439 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccgtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgcctggctcttgggccactgaa

SEQ ID NO: 9001 - DNA, 484 bp, Artificial; identical to SEQ ID NO: 8845
  TaSBEIIa allele with mutations introduced by TALEN pair TaSBEIIa_T03

SEQ ID NO: 9002 - DNA, 481 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccctggtgcctgacggcgagagcgacgacttggcaagtccggcgcaacctgaagaattacaggtacacacactcgtgccggtaaatcttcatacaatcgttatcacttaccaaatgccggatgaaaccaaccacggatgcgtcaggtttcgagcttcttctatcagcattgtgcagtactgcactgccttgttctattttgttagtccttggccccgtgctggctcttgggccactgaa

SEQ ID NO: 9003 - DNA, 469 bp, Artificial
  TaSBEIIa allele with mutations introduced by TALEN pair TaSBEIIa_T03
gagagatagctggattaggcgatcgcgcttcctgaacctgtattttttcccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 9004 - DNA, 484 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgtagccttggccccgtgctggctcttgggccactgaa

SEQ ID NO: 9005 - DNA, 441 bp, Artificial; identical to SEQ ID NO: 8771
  TaSBEIIa allele with mutations introduced by TALEN pair TaSBEIIa_T03

SEQ ID NO: 9006 - DNA, 482 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcgtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 9007 - DNA, 485 bp, Artificial; identical to SEQ ID NO: 8807
  TaSBEIIa allele with mutations introduced by TALEN pair TaSBEIIa_T03

SEQ ID NO: 9008 - DNA, 483 bp, Artificial
  TaSBEIIa allele with mutations introduced by TALEN pair TaSBEIIa_T03
gagagaagctggattaggcgatcgcgcttcctgaacctgtattttttccccgcggggaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 9009 - DNA, 476 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccatgcttccggctcgtatgttgtgtggaattgtgagcggataacaatttcacacaggaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagcgtggtccccg

SEQ ID NO: 9010 - DNA, 486 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcgaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 9011 - DNA, 475 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcctgcctgacggcgagagcgacgacttggcaagtccggcgcaacctgaagaattacaggtacacacactcgtgccggtaaatcttcatacaatcgttattcacttaccaatgccggatgaaaccagccgcggaggcgtcaggttttgagcttcttctatcagcattgtgcagtactgcactgccttgtgcattttgttagccgtggccccgtgctggctcttgggccactgaa

SEQ ID NO: 9012 - DNA, 486 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaaccaaccacggatgcgtcaggtttcgagcttcttctatcagcattgtgcagtactgcactgccttgtcattttgttagccttggccccgtgctggctcttgggccactgaa

SEQ ID NO: 9013 - DNA, 474 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 9014 - DNA, 494 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggcgatggccaccacctgctccggggtcaagccgtgggaaggtcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttctctatcagcattgtgcagtactgcactgccttgtcattttgtagccttgg

SEQ ID NO: 9015 - DNA, 483 bp, Artificial; identical to SEQ ID NO: 8895
  TaSBEIIa allele with mutations introduced by TALEN pair TaSBEIIa_T03

SEQ ID NO: 9016 - DNA, 484 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctctggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 9017 - DNA, 463 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccgagagcgacgacttggcaagtccggcgcaacctgaagaattacaggtacacacactcgtgcccggtaaatcttcatacaatcgttattcacttaccaatgccgatgaaaccaaccacggatgcgtcaggtttcgagcttctctatcagcattgtgcagtactgcactgccttgttcattttgttagccttggccccgtgctggctcttgggccactgaa

SEQ ID NO: 9018 - DNA, 479 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 9019 - DNA, 485 bp, Artificial; identical to SEQ ID NO: 8782
  TaSBEIIa allele with mutations introduced by TALEN pair TaSBEIIa_T03

SEQ ID NO: 9020 - DNA, 480 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctgtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcacttttgttagccttggccccgtgctggctcttgggccactgaa

SEQ ID NO: 9021 - DNA, 508 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggtcaagccgtgggcctggcacagcaccggaaggtcctggtgcctgacggcgagagcgacgacttggcaagtccggcgcaacctgaagaattacaggtacacacactcgtgcccggtaaatcttcatacaatcgttattcacttaccaaatgccggatgaaaccaaccacggatgcgtcaggtttcgagcttcttctatcagcattgtgcagtactgcactgccttgttcatttgttagccttggccccgtgctggctcttc

SEQ ID NO: 9022 - DNA, 486 bp, Artificial; identical to SEQ ID NO: 8779
  TaSBEIIa allele with mutations introduced by TALEN pair TaSBEIIa_T03

SEQ ID NO: 9023 - DNA, 481 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagtccttggccccgtgctggctcttgggccactgaa

SEQ ID NO: 9024 - DNA, 486 bp, Artificial; identical to SEQ ID NO: 8770
  TaSBEIIa allele with mutations introduced by TALEN pair TaSBEIIa_T03

SEQ ID NO: 9025 - DNA, 487 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaacccaaccacggatgcgtcaggtttcgagcttcttctatcagcattgtgcagtactgcactgccttgttcattttgttagccttggccccgtgctggctcttgggccactgaa

SEQ ID NO: 9026 - DNA, 484 bp, Artificial; identical to SEQ ID NO: 8913
  TaSBEIIa allele with mutations introduced by TALEN pair TaSBEIIa_T03

SEQ ID NO: 9027 - DNA, 454 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactcttttcttcctgttcttgctgtaactgcaagttgtggcgttttttcactattgtagtcatccttgcattttgcaggcgccgtcctgagccgcgcggcgcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 9028 - DNA, 489 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttgggcaagtccggcgcaacctgaagaattacaggtacacacactcgtgccggtaaaatcttcatacaatcgttattcacttaccaaatgccggatgaaaaccaaccacggatgcgtcaggtttcgagcttcttctatcagcattgtgcagtactgcactgccttgttcattttgttagccttggccccgtgctggctcttgggccactgaa

SEQ ID NO: 9029 - DNA, 485 bp, Artificial; identical to SEQ ID NO: 8782
  TaSBEIIa allele with mutations introduced by TALEN pair TaSBEIIa_T03

SEQ ID NO: 9030 - DNA, 486 bp, Artificial; identical to SEQ ID NO: 8818
  TaSBEIIa allele with mutations introduced by TALEN pair TaSBEIIa_T03

SEQ ID NO: 9031 - DNA, 482 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctgtcctggtgcctgacggcgagagcgacgacttggcaagtccggcgcaacctgaagaattacaggtacacacactcgtgccggtaaatcttcatacaatcgttattcacttaccaaatgccggatgaaaaccaaccacggatgcgtcaggtttcgagcttcttctatcagcattgtgcagtactgcactgccttgttcattttgttagccttggccccgtgctggctcttgggccactgaa

SEQ ID NO: 9032 - DNA, 485 bp, Artificial; identical to SEQ ID NO: 8782
  TaSBEIIa allele with mutations introduced by TALEN pair TaSBEIIa_T03

SEQ ID NO: 9033 - DNA, 474 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggccctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttctctatcagcattgtgcagtactgcactgccttgttcattttgttagccttggccccgtgctggctcttgggccactgaa

SEQ ID NO: 9034 - DNA, 474 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcctgcctgacggcgagagcgacgacttggcaagtccggcgcaacctgaagaattacaggtacacacactcgtgccggtaaatcttcatacaatcgttatcacttaccaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 9035 - DNA, 485 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaatgccggatgaaaccaaccacggatgcgtcaggtttcgagcttcttctatcagcattgtgcagtactgcactagccttgttcattttgttagccttggccccgtgctggctcttgggccactgaa

SEQ ID NO: 9036 - DNA, 486 bp, Artificial; identical to SEQ ID NO: 8770
  TaSBEIIa allele with mutations introduced by TALEN pair TaSBEIIa_T03

SEQ ID NO: 9037 - DNA, 489 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccaccggatgcgtcaggtttcgagcgttcttctatcagcattgtgcagtactgcactgccttgttcattttgttagccttggccccgtgctggctcgttgggccactgaa

SEQ ID NO: 9038 - DNA, 480 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccctggtgcctgacggcgagagcgacgacttggcaagtccggcgcaacctgaagaattacaggtacacacactcgtgccggtaaatcttcatacaatcgttattcacttaccaaatgccggatgaaaaccaaccacggatgcgtcaggtttcgagcttcttctatcagcattgtgcagtactgcactgccttgttcattttgtagccttggccccgtgctggctcttgggccactgaa

SEQ ID NO: 9039 - DNA, 459 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggtccccgtgcctggctcttgggtcactgaa

SEQ ID NO: 9040 - DNA, 521 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaagattctccaaaaaaatcttcatggtaaccgtccctctcgaaggatgtttttcagtatccggctaaaagggaaaggtcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttt

SEQ ID NO: 9041 - DNA, 440 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggtttgagcttcttctatcagcattgtgcagtactgcactgccttgtgcattttgtagccgtggccccgtgctggctcttgggccactgaa

SEQ ID NO: 9042 - DNA, 485 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcaggtcctggtgcctgacggcgagagcgacgacttggcaagtccggcgcaacctgaagaattacaggtacacacactcgtgccggtaaatcttcatacaatcgttattcacttaccaaatgccggatgaaaaccaaccaggatgcgtcaggtttcgagcttcttctatcagcattgtgcagtactgcactgccttgttcattttgttagccttggccccgtgcctggctcttgggccactgaa

SEQ ID NO: 9043 - DNA, 487 bp, Artificial; identical to SEQ ID NO: 8931
  TaSBEIIa allele with mutations introduced by TALEN pair TaSBEIIa_T03

SEQ ID NO: 9044 - DNA, 492 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccagtttttgacggttgttttccgcgttaccagcagcgttaacggtgatggtaaggtcctggtgcctgacggtgagagcgacgacttggcaagtccggcgcaacctgaagaattacaggtacacaccatcgtgccgggaaatcttcatacaatcgttattcacttaccaatgccggatgaaaccaagccgcggaggcgtcgaggttttgagtcttcttctatcagcattgtgcagtactgcactgccttgtgcattttgtagtccgtggccccgtgctggctcgttgggcctacg

SEQ ID NO: 9045 - DNA, 486 bp, Artificial; identical to SEQ ID NO: 8887
  TaSBEIIa allele with mutations introduced by TALEN pair TaSBEIIa_T03

SEQ ID NO: 9046 - DNA, 480 bp, Artificial; identical to SEQ ID NO: 8892
  TaSBEIIa allele with mutations introduced by TALEN pair TaSBEIIa_T03

SEQ ID NO: 9047 - DNA, 477 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccatgcttccggctcgtatgttgtgtggaattgtgagcggataacaatttcacacaggaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagtccgtggtcccc

SEQ ID NO: 9048 - DNA, 483 bp, Artificial; identical to SEQ ID NO: 8810
  TaSBEIIa allele with mutations introduced by TALEN pair TaSBEIIa_T03

SEQ ID NO: 9049 - DNA, 464 bp, Artificial
  TaSBEIIa allele with mutations introduced by TALEN pair TaSBEIIa_T03
gagagatagctggattaggcgatcgcgcttcctgaacctgtattttttcccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 9050 - DNA, 475 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggccctggtgcctgacggcgagagcgacgacttggcaagtccggcgcaacctgaagaattacaggtacacacactcgtgaccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 9051 - DNA, 484 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgtattcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 9052 - DNA, 485 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttatcacttacaatgccggatgaaaccaaccacggatgcgtcaggtttcgagcttcttctatcagcattgtgcagtactgcactgccttgttctattttgttagtccttggccccgttgctggctcttgggccactgaa

SEQ ID NO: 9053 - DNA, 505 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggatcttaccgctgttgagatccagttcgatgtaacccactcgtgcacccaactgatcttcagcatcttttacttcaccagcgtttctgggtgagcaaaaacaggaaggcaaaatgccgcaggtcctggtgcctgacggcgagagcgacgacttggcaagtccggcgcaacctgaagaattacaggtacacacactcgtgccggtaaatcttcatacaatcgtatcacttacaatgccgatgaaaccaacacggatgcgt

SEQ ID NO: 9054 - DNA, 480 bp, Artificial; identical to SEQ ID NO: 8892
  TaSBEIIa allele with mutations introduced by TALEN pair TaSBEIIa_T03

SEQ ID NO: 9055 - DNA, 473 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggccctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcatttgttagccttggccccgtgctggctctgggccactgaa

SEQ ID NO: 9056 - DNA, 482 bp, Artificial; identical to SEQ ID NO: 9006
  TaSBEIIa allele with mutations introduced by TALEN pair TaSBEIIa_T03

SEQ ID NO: 9057 - DNA, 481 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcgtcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 9058 - DNA, 474 bp, Artificial; identical to SEQ ID NO: 9013
  TaSBEIIa allele with mutations introduced by TALEN pair TaSBEIIa_T03

SEQ ID NO: 9059 - DNA, 483 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggtcctggtgcctgacggcgagagcgacgacttggcaagtccggcgcaacctgaagattacaggtacacacactcgtgccggtaaatcttcatacaatcgtattcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 9060 - DNA, 486 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgtagccttggccccgtgctgggctcttgggccactgaa

SEQ ID NO: 9061 - DNA, 486 bp, Artificial; identical to SEQ ID NO: 8779
  TaSBEIIa allele with mutations introduced by TALEN pair TaSBEIIa_T03

SEQ ID NO: 9062 - DNA, 483 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgtagccttggccccgtgctggctcttgggccactgaa

SEQ ID NO: 9063 - DNA, 485 bp, Artificial; identical to SEQ ID NO: 8782
  TaSBEIIa allele with mutations introduced by TALEN pair TaSBEIIa_T03

SEQ ID NO: 9064 - DNA, 486 bp, Artificial; identical to SEQ ID NO: 8887
  TaSBEIIa allele with mutations introduced by TALEN pair TaSBEIIa_T03

SEQ ID NO: 9065 - DNA, 489 bp, Artificial; identical to SEQ ID NO: 8848
  TaSBEIIa allele with mutations introduced by TALEN pair TaSBEIIa_T03

SEQ ID NO: 9066 - DNA, 487 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaacccaaccacggatgcgtcaggtttcgagcttcttctatcagcattgtgcagtactgcactgccttgttctattttgttagccttggccccgtgctggctcttgggccactgaa

SEQ ID NO: 9067 - DNA, 486 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcaaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcatttgttagtccttggccccgtgctggctcttgggccactgaa

SEQ ID NO: 9068 - DNA, 455 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctcttcgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 9069 - DNA, 486 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagtccttggcccccgtgctggctcttgggcactgaa

SEQ ID NO: 9070 - DNA, 485 bp, Artificial; identical to SEQ ID NO: 8782
  TaSBEIIa allele with mutations introduced by TALEN pair TaSBEIIa_T03

SEQ ID NO: 9071 - DNA, 487 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccagttttttgacggtgttttccgcgttaccagcagcgttaacggtgatggtaaggtcctggtgcctgacggtgagagcgacgacttggcaagtccggcgcaacctgaagaattacaggtacacaccatcgtgccgggaaatcttcatacaatcgttattcacttaccaatgccggatgaaaccaagccgcggagcgtcaggtttgagcttcttctatcagcattgtgcagtactgcactgccttgtgctattttgtagccgtggccccgtgctggctcgtgggcctacg

SEQ ID NO: 9072 - DNA, 522 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaagattctccaaaaaaatcttcatggtaaccgtccctctcgaaggatgttttcagtatccggctaaaagggaaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcatttttg

SEQ ID NO: 9073 - DNA, 483 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgtcattttgttagccttggccccgtgctggctcttgggccactgaa

SEQ ID NO: 9074 - DNA, 474 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcgtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 9075 - DNA, 454 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcgcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 9076 - DNA, 485 bp, Artificial; identical to SEQ ID NO: 8782
  TaSBEIIa allele with mutations introduced by TALEN pair TaSBEIIa_T03

SEQ ID NO: 9077 - DNA, 467 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 9078 - DNA, 486 bp, Artificial; identical to SEQ ID NO: 8861
  TaSBEIIa allele with mutations introduced by TALEN pair TaSBEIIa_T03

SEQ ID NO: 9079 - DNA, 423 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgcctggctcttgggccactgaa

SEQ ID NO: 9080 - DNA, 484 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcatttgttagccttggccccgtgctggctcttgggccactgaa

SEQ ID NO: 9081 - DNA, 438 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctcgtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcgttgggccactgaa

SEQ ID NO: 9082 - DNA, 486 bp, Artificial; identical to SEQ ID NO: 8779
  TaSBEIIa allele with mutations introduced by TALEN pair TaSBEIIa_T03

SEQ ID NO: 9083 - DNA, 479 bp, Artificial; identical to SEQ ID NO: 9018
  TaSBEIIa allele with mutations introduced by TALEN pair TaSBEIIa_T03

SEQ ID NO: 9084 - DNA, 471 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctcgaatggcgaatggcgcctgatgcggtattttctccttacgcatctgtgcggaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgt

SEQ ID NO: 9085 - DNA, 487 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagtccttggccccgtgctggctcttgggccactgaa

SEQ ID NO: 9086 - DNA, 490 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaccggcaacagccgctggaccgtctccagcgcctgcttgccaccaatattgctggcgatggccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagta

SEQ ID NO: 9087 - DNA, 487 bp, Artificial; identical to SEQ ID NO: 8806
  TaSBEIIa allele with mutations introduced by TALEN pair TaSBEIIa_T03

SEQ ID NO: 9088 - DNA, 483 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctttggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagccttggccccgtgctggctcttgggccactgaa

SEQ ID NO: 9089 - DNA, 486 bp, Artificial; identical to SEQ ID NO: 8887
  TaSBEIIa allele with mutations introduced by TALEN pair TaSBEIIa_T03

SEQ ID NO: 9090 - DNA, 482 bp, Artificial
  TaSBEIIa allele with mutations introduced by TALEN pair TaSBEIIa_T03
gagagatagctggattaaggcgatcgcgcttcctgaacctgtattttttcccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccggtcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagcttggccccgtgctggctcttgggccactgaa

SEQ ID NO: 9091 - DNA, 487 bp, Artificial; identical to SEQ ID NO: 8806
  TaSBEIIa allele with mutations introduced by TALEN pair TaSBEIIa_T03

SEQ ID NO: 9092 - DNA, 465 bp, Artificial; identical to SEQ ID NO: 8878
  TaSBEIIa allele with mutations introduced by TALEN pair TaSBEIIa_T03

SEQ ID NO: 9093 - DNA, 488 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaaggtcctggtgcctgacggcgagagcgacgacttggcaagtccggcgcaacctgaagaattacaggtacacacactcgtgccggtaaatcttcatacaatcgttattcacttaccaaatgccggatgaaaaccaaccacggatgcgtcaggtttcgagcttcttctatcagcattgtgcagtactgcactgccttgttcattttgttagccttggccccgtgctggctcttgggccactgaa

SEQ ID NO: 9094 - DNA, 489 bp, Artificial
  TaSBEIIa allele with mutations introduced by TALEN pair TaSBEIIa_T03
gagagatagctggattaggcgatcgcgcttcctgaacctgtattttttccccgcggggaaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaaatcttcatacaatcgttattcacttaccaaatgccggatgaaaaccaaccacggatgcgtcaggtttcgagcttcttctatcagcattgtgcagtactgcactgccttgttcattttgttagccttggccccgtgctggctcttgggccactgaa

SEQ ID NO: 9095 - DNA, 486 bp, Artificial; identical to SEQ ID NO: 8779
  TaSBEIIa allele with mutations introduced by TALEN pair TaSBEIIa_T03

SEQ ID NO: 9096 - DNA, 484 bp, Artificial; identical to SEQ ID NO: 8973
  TaSBEIIa allele with mutations introduced by TALEN pair TaSBEIIa_T03

SEQ ID NO: 9097 - DNA, 473 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagtccttggccccgtgctggctcttgggccactgaa

SEQ ID NO: 9098 - DNA, 486 bp, Artificial; identical to SEQ ID NO: 8779
  TaSBEIIa allele with mutations introduced by TALEN pair TaSBEIIa_T03

SEQ ID NO: 9099 - DNA, 486 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagtccttggccccgtgctggctcttgggccactgaa

SEQ ID NO: 9100 - DNA, 487 bp, Artificial; identical to SEQ ID NO: 8912
  TaSBEIIa allele with mutations introduced by TALEN pair TaSBEIIa_T03

SEQ ID NO: 9101 - DNA, 480 bp, Artificial; identical to SEQ ID NO: 8789
  TaSBEIIa allele with mutations introduced by TALEN pair TaSBEIIa_T03

SEQ ID NO: 9102 - DNA, 483 bp, Artificial
  TaSBEIIa allele with mutations introduced by TALEN pair TaSBEIIa_T03
gagagatagctggattaggcgatcgcgcttcctgaacctgtattttttcccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctctggtcctggtgcctgacggcgagagcgacgacttggcaagtccggcgcaacctgaagaattacaggtacacacactcgtgccggtaaatcttcatacaatcgttattcacttaccaaatgccggatgaaaaccaaccacggatgcgtcaggtttcgagcttcttctatcagcattgtgcagtactgcactgccttgttcattttgtagccttggccccgtgctggctcttgggccactgaa

SEQ ID NO: 9103 - DNA, 479 bp, Artificial; identical to SEQ ID NO: 9018
  TaSBEIIa allele with mutations introduced by TALEN pair TaSBEIIa_T03

SEQ ID NO: 9104 - DNA, 484 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 9105 - DNA, 444 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattttgcaggcgccgtcctgagccgcgcggcctctccagaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 9106 - DNA, 480 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccgtcctggtgcctgacggcgagagcgacgacttggcaagtccggcgcaacctgaagaattacaggtacacacactcgtgccggtaaatcttcatacaatcgttatcacttaccaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 9107 - DNA, 486 bp, Artificial; identical to SEQ ID NO: 8887
  TaSBEIIa allele with mutations introduced by TALEN pair TaSBEIIa_T03

SEQ ID NO: 9108 - DNA, 487 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagccttggcccccgtgctggctcttgggccactgaa

SEQ ID NO: 9109 - DNA, 488 bp, Artificial
  TaSBEIIa allele with mutations introduced by TALEN pair TaSBEIIa_T03
gagagatagctggattaggcgatcgcgcttcctgaacctgtattttttccccgtcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaacccaaccacggatgcgtcaggtttcgagcttcttctatcagcattgtgcagtactgcactgccttgttcattttgttagccttggccccgtgctggctcttgggccactgaa

SEQ ID NO: 9110 - DNA, 481 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagccttggccccgtgctggtctcttcgggccactga

SEQ ID NO: 9111 - DNA, 485 bp, Artificial
  TaSBEIIa allele with mutations introduced by TALEN pair TaSBEIIa_T03
gagagatagctggattaggcgatcgcgcttcctgaacctgttatttttttccccgcggggaaatgcgttagtgtcacccaggcccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctcaaggtcctggtgcctgacggcgagagcgacgacttggcaagtccggcgcaacctgaagaattacaggtacacacactcgtgccggtaaatcttcatacaatcgttatcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 9112 - DNA, 485 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctctggtcctggtgcctgacggcgagagcgacgacttggcaagtccggcgcaacctgaagaattacaggtacacacactcgtgccggtaaatcttcatacaatcgttattcacttaccaaatgccggatgaaaaccaaccacggatgcgtcaggtttcgagcttcttctatcagcattgtgcagtactgcactgccttgttcattttgttagccttggccccgtgctggctcttgggccactgaa

SEQ ID NO: 9113 - DNA, 474 bp, Artificial; identical to SEQ ID NO: 9013
  TaSBEIIa allele with mutations introduced by TALEN pair TaSBEIIa_T03

SEQ ID NO: 9114 - DNA, 488 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagtccttggccccgtgctggctcttgggccactgaa

SEQ ID NO: 9115 - DNA, 487 bp, Artificial; identical to SEQ ID NO: 8931
  TaSBEIIa allele with mutations introduced by TALEN pair TaSBEIIa_T03

SEQ ID NO: 9116 - DNA, 485 bp, Artificial; identical to SEQ ID NO: 8782
  TaSBEIIa allele with mutations introduced by TALEN pair TaSBEIIa_T03

SEQ ID NO: 9117 - DNA, 486 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaacacggatgcgtcaggtttcgagcttcttctatcagcattgtgcagtactgcactgccttgttcattttgttagtccttggccccgtgctggctcttgggccactgaa

SEQ ID NO: 9118 - DNA, 486 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcaggtcctggtgcctgacggcgagagcgacgacttggcaagtccggcgcaacctgaagaattacaggtacacacactcgtgccggtaaatcttcatacaatcgttattcacttaccaaatgccggatgaaaaccaaccacggatgcgtcaggtttcgagcttcttctatcagcattgtgcagtactgcactgccttgttcattttgttagccttggccccgtgctggctcttagggccactgaa

SEQ ID NO: 9119 - DNA, 485 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaaccaaccacggatgcgtcaggtttcgagcttcttctatcagcattgtgcagtactgcactgccttgttcatttgttagccttggccccgtgctggctcttgggccactgaa

SEQ ID NO: 9120 - DNA, 476 bp, Artificial; identical to SEQ ID NO: 8919
  TaSBEIIa allele with mutations introduced by TALEN pair TaSBEIIa_T03

SEQ ID NO: 9121 - DNA, 485 bp, Artificial
  TaSBEIIa allele with mutations introduced by TALEN pair TaSBEIIa_T03
gagagatagctggattagggcgatcgcgcttcctgaacctgtattttttcccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctccaaggtcctggtgcctgacggcgagagcgacgacttggcaagtccggcgcaacctgaagaattacaggtacacacactcgtgccggtaaatcttcatacaatcgttattcacttaccaaatgccggatgaaaaccaaccacggatgcgtcaggtttcgagcttcttctatcagcattgtgcagtactgcactgccttgttcattttgttagccttggccccgtgctggctcttgggccactgaa

SEQ ID NO: 9122 - DNA, 481 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccggtcctggtgcctgacggcgagagcgacgacttggcaagtccggcgcaacctgaagaattacaggtacacacactcgtgccggtaaatcttcatacaatcgttatcacttaccaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 9123 - DNA, 485 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgtagtccttggccccgtgctggctctgggccactgaa

SEQ ID NO: 9124 - DNA, 440 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctcaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 9125 - DNA, 449 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggcccctgctggctcttgggccactgaa

SEQ ID NO: 9126 - DNA, 486 bp, Artificial; identical to SEQ ID NO: 8779
  TaSBEIIa allele with mutations introduced by TALEN pair TaSBEIIa_T03

SEQ ID NO: 9127 - DNA, 484 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcgtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagtccttggccccgtgctggctcttgggccactgaa

SEQ ID NO: 9128 - DNA, 481 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctgtcctggtgcctgacggcgagagcgacgacttggcaagtccggcgcaacctgaagaattacaggtacacacactcgtgccggtaaatcttcatacaatcgttattcacttaccaaatgccggatgaaaccaacacggatgcgtcaggtttcgagcttcttctatcagcattgtgcagtactgcactgccttgttcattttgttagccttggccccgtgctgggctcttgggccactgaa

SEQ ID NO: 9129 - DNA, 485 bp, Artificial; identical to SEQ ID NO: 8782
  TaSBEIIa allele with mutations introduced by TALEN pair TaSBEIIa_T03

SEQ ID NO: 9130 - DNA, 486 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggttcgagcttcttctatcagcattgtgcagtactgcactgccttgttctattttgttagtccttggccccgtgctggctcttgggccactcgaa

SEQ ID NO: 9131 - DNA, 490 bp, Artificial
  TaSBEIIa allele with mutations introduced by TALEN pair TaSBEIIa_T03
gagagatagctggataggcgatcgcgcttcctgaacctgtattttttccccgcgggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagtccttgggcccccgtgcctgggctcttgggccactgaa

SEQ ID NO: 9132 - DNA, 488 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaaacctgaagaattacaggtacacacactcgtgccggtaaatcttcatacaatcgttattcacttaccaaatgccggatgaaaaccaaccacggatgcgtcaggtttcgagcttcttctatcagcattgtgcagtactgcactgccttgttcattttgttagccttggccccgtgctggctcttgggccactgaa

SEQ ID NO: 9133 - DNA, 488 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacgactttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggtcctggtgcctgacggcgagagcgacgacttggcaagtccggcgcaacctgaagaattacaggtacacacactcgtgccggtaaatcttcatacaatcgttattcacttaccaaatgccggatgaaaaccaaccacggatgcgtcaggtttcgagcttcttctatcagcattgtgcagtactgcactgccttgttcattttgttagccttggcccccgtgctggctcttgggccactgaa

SEQ ID NO: 9134 - DNA, 486 bp, Artificial; identical to SEQ ID NO: 8779
  TaSBEIIa allele with mutations introduced by TALEN pair TaSBEIIa_T03

SEQ ID NO: 9135 - DNA, 484 bp, Artificial; identical to SEQ ID NO: 8867
  TaSBEIIa allele with mutations introduced by TALEN pair TaSBEIIa_T03

SEQ ID NO: 9136 - DNA, 484 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaacacggatgcgtcaggtttcgagcttcttctatcagcattgtgcagtactgcactgccttgttcattttgttagccttggccccgtgctggctcttgggccactgaa

SEQ ID NO: 9137 - DNA, 487 bp, Artificial; identical to SEQ ID NO: 8806
  TaSBEIIa allele with mutations introduced by TALEN pair TaSBEIIa_T03

SEQ ID NO: 9138 - DNA, 517 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggcgatggccaccacctgctccggggtcaagccgtgggaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagtccgtttcggccccgtgtctgggt

SEQ ID NO: 9139 - DNA, 499 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagagaaaataccgcatcaggcgccattcgccattcaggctgcgcaactgttgggaagggcgatcggtgcgggaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagta

SEQ ID NO: 9140 - DNA, 487 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgtagccttggccccgtgctggctcgttgggccactgaa

SEQ ID NO: 9141 - DNA, 485 bp, Artificial; identical to SEQ ID NO: 8782
  TaSBEIIa allele with mutations introduced by TALEN pair TaSBEIIa_T03

SEQ ID NO: 9142 - DNA, 508 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcaacgtcaaatttcccatacagagctaagggataatgcgtagcgttcacgtaactggaaggtcctggtgcctgacggcgagagcgacgacttggcaagtccggcgcaacctgaagaattacaggtacacacactcgtgacccggtaaatcttcatacaatcgttattcacttaccaaatgccggatgaaaccaaccacggatgcgtcaggttcgagcttcttctatcagcattgtgcagtactgcactgccttgttctattttgtt

SEQ ID NO: 9143 - DNA, 483 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctaggtcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagtccttggccccgtgctggctcttgggccactgaa

SEQ ID NO: 9144 - DNA, 489 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagtcttcttctatcagcattgtgcagtactgcactgcctttgttctattttgttagtccttggccccgtgctggctcttgggccactgaa

SEQ ID NO: 9145 - DNA, 486 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccgtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcatttttgttagtccttcggccccgtgctggctcttgggccactgaa

SEQ ID NO: 9146 - DNA, 485 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaaggtcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcatttgttagccttggccccgtgctggctcttgggccactgaa

SEQ ID NO: 9147 - DNA, 485 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaaccaacacggatgcgtcaggtttcgagcttcttctatcagcattgtgcagtactgcactgccttgttcattttgttagccttggccccgtgctggctcttgggccactgaa

SEQ ID NO: 9148 - DNA, 485 bp, Artificial; identical to SEQ ID NO: 8782
  TaSBEIIa allele with mutations introduced by TALEN pair TaSBEIIa_T03

SEQ ID NO: 9149 - DNA, 485 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttatcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 9150 - DNA, 486 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgcctggctcttgggccactgaa

SEQ ID NO: 9151 - DNA, 523 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggagcagacaagcccgtcagggcgcgtcagcgggtgttggcgggtgtcgggggagcccacggtgtagatggcgccgtcgggcttcctggagccgcccaggtgcttgccaaggtcctggtgcctgacggcgagagcgacgacttggcaagtccggcgcaacctgaagaattacaggtacacacactcgtgccgggtaaatcttcatacaatcgttattcacttaccaaatgccggatgaaaccaaccacggatgcgtcaggtttcgagcttcttctta

SEQ ID NO: 9152 - DNA, 488 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagtccttggccccgtgctggctcttcgggccactgaa

SEQ ID NO: 9153 - DNA, 481 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcatttttgcaggcgccgtcctgagccgcgcggcctcttcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 9154 - DNA, 481 bp, Artificial; identical to SEQ ID NO: 8784
  TaSBEIIa allele with mutations introduced by TALEN pair TaSBEIIa_T03

SEQ ID NO: 9155 - DNA, 432 bp, Artificial
  TaSBEIIa allele with mutations introduced by TALEN pair TaSBEIIa_T03
gagagatagctggattaggcgatcgcctcaggccctggtgttaccacggctttgatcatctcctcctttcatgctgatattttctcactctttcttctgttcttgctgtaactgcaagttgtggcgttttttcactattgtagtcatccttgcattttgcaggcgccgtcctgagccgcgcggcctctccagggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcactacttcactgccttgtgcagtttgttagctgtggccccgcgctggctcttgggccactgaa

SEQ ID NO: 9156 - DNA, 476 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggccctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggcccccgtgctggctcttgggccactgaa

SEQ ID NO: 9157 - DNA, 485 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgtattcacttaccaaatgccggatgaaaccaaccacggatgcgtcaggtttcgagcttcttctatcagcattgtgcagtactgcactgccttgttctattttgttagccttggccccgtgctggctcttgggccactgaa

SEQ ID NO: 9158 - DNA, 485 bp, Artificial; identical to SEQ ID NO: 8807
  TaSBEIIa allele with mutations introduced by TALEN pair TaSBEIIa_T03

SEQ ID NO: 9159 - DNA, 485 bp, Artificial; identical to SEQ ID NO: 8782
  TaSBEIIa allele with mutations introduced by TALEN pair TaSBEIIa_T03

SEQ ID NO: 9160 - DNA, 489 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttgggcaagtcccggcgcaacctgaagaatttacaggtacacacactcgtgccggtaaatcttcatacaatcgttattcacttaccaaatgccggatgaaaaccaaccacggatgcgtcaggtttcgagcttcttctatcagcattgtgcagtactgcactgccttgttcattttgttagccttggccccgtgctggctcttgggccactgaa

SEQ ID NO: 9161 - DNA, 502 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagtctccagcgcctgttgccggtgctgtgccaggcccacggcttgaccccggagcaggtggtggaaggtcctggtgcctgacggcgagagcgacgacttggcaagtccggcgcaacctgaagaattacaggtacacacactcgtgccggtaaatcttcatacaatcgttattcacttaccaaatgccggatgaaaccacacggatgcgtcaggtttcgagcttcttctatcagcattgtgcagtactgcactgccttt

SEQ ID NO: 9162 - DNA, 450 bp, Artificial; identical to SEQ ID NO: 8968
  TaSBEIIa allele with mutations introduced by TALEN pair TaSBEIIa_T03

SEQ ID NO: 9163 - DNA, 484 bp, Artificial; identical to SEQ ID NO: 8985
  TaSBEIIa allele with mutations introduced by TALEN pair TaSBEIIa_T03

SEQ ID NO: 9164 - DNA, 485 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaaccaaccacggatgcgtcaggttcgagcttcttctatcagcattgtgcagtactgcactgccttgttcattttgttagccttagccccgtgctggctcttgggccactgaa

SEQ ID NO: 9165 - DNA, 486 bp, Artificial; identical to SEQ ID NO: 8779
  TaSBEIIa allele with mutations introduced by TALEN pair TaSBEIIa_T03

SEQ ID NO: 9166 - DNA, 498 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaccagcaatattggtggcaagcaggcgctggaaaggtcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgtcatttcgtagccttgcccgtgctggt

SEQ ID NO: 9167 - DNA, 486 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcgttgggccactgaa

SEQ ID NO: 9168 - DNA, 479 bp, Artificial
  TaSBEIIa allele with mutations introduced by TALEN pair TaSBEIIa_T03
gatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccgtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 9169 - DNA, 474 bp, Artificial
  TaSBEIIa allele with mutations introduced by TALEN pair TaSBEIIa_T03
gagagatagctggattaggctatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctcgaatggcgaatggcgcctgatgcggtattttctccttacgcatctgtgcggaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgcc

SEQ ID NO: 9170 - DNA, 486 bp, Artificial; identical to SEQ ID NO: 8779
  TaSBEIIa allele with mutations introduced by TALEN pair TaSBEIIa_T03

SEQ ID NO: 9171 - DNA, 482 bp, Artificial
  TaSBEIIa allele with mutations introduced by TALEN pair TaSBEIIa_T03
gagagatagctggattaggcgatcgcgcttcctgaacctgtattttttcccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcaaggtcctggtgcctgacggcgagagcgacgacttggcaagtccggcgcaacctgaagaattacaggtacacacactcgtgccggtaaatcttcatacaatcgttatcacttaccaaatgccggatgaaaccaaccacggatgcgtcaggtttcgagcttcttctatcagcattgtgcagtactgcactgccttgttcattttgtagccttggccccgtgctggctcttgggccactgaa

SEQ ID NO: 9172 - DNA, 488 bp, Artificial
  TaSBEIIa allele with mutations introduced by TALEN pair TaSBEIIa_T03
gagagatagctggattaggcgatcgcgcttcctgaacctgttattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggtcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgcctgggctcttgggccactgaa

SEQ ID NO: 9173 - DNA, 487 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagtccttggccccgtgctgctcttgggccactgaa

SEQ ID NO: 9174 - DNA, 487 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacgactttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggtcctggtgcctgacggcgagagcgacgacttggcaagtccggcgcaacctgaagaattacaggtacacacactcgtgccggtaaatcttcatacaatcgttattcacttaccaaatgccggatgaaaaccaccacggatgcgtcaggtttcgagcttctctatcagcattgtgcagtactgcactgccttgttcattttgtagccttggccccgtgctggctcgtttagggccactgaa

SEQ ID NO: 9175 - DNA, 471 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagcctttggcccctgctggctcttgggccactgaa

SEQ ID NO: 9176 - DNA, 514 bp, Artificial
  TaSBEIIa allele with mutations introduced by TALEN pair TaSBEIIa_T03
gagagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaccgtattaccgcctttgagtgagctgataccgctcgccgcagccgaaggtcctggtgcctgacggcgagagcgacgacttggcaagtccggcgcaacctgaagaattacaggtacacacactcgtgcccggtaaatcttcatacaatcgttattcacttaccaaatgccggatgaaaccaaccacggatgcgtcaggtttcgagtcttcttctatcagcattgtgcagtactgcactgccttgttcattttgttagccttggtccccg

SEQ ID NO: 9177 - DNA, 486 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaaggtcctggtgcctgacggcgagagcgacgacttggcaagtccggcgcaaacctgaagaattacaggtacacacactcgtgccggtaaatcttcatacaatcgtattcacttaccaaatgccggatggaaaccaaccacggatgcgtcaggtttcgagcttcttctatcagcatgtgcagtactgcactgccttgttcatttgttagccttggccccgtgctggctcttgggccactgaa

SEQ ID NO: 9178 - DNA, 485 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccgtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagccttggcccccgtgctggctcttgggccactgaa

SEQ ID NO: 9179 - DNA, 485 bp, Artificial; identical to SEQ ID NO: 8782
  TaSBEIIa allele with mutations introduced by TALEN pair TaSBEIIa_T03

SEQ ID NO: 9180 - DNA, 489 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagtccttggccccgtgctggctcttgggccactgaa

SEQ ID NO: 9181 - DNA, 486 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgtagccttggccccgtgctggctcgttgggccactgaa

SEQ ID NO: 9182 - DNA, 483 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagccttggccccgtgctggctcgttgggccactgaa

SEQ ID NO: 9183 - DNA, 485 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggttcgagcttctctatcagcattgtgcagtactgcactgccttgttctattttgttagccttggccccgtgctggctcttgggccactgaa

SEQ ID NO: 9184 - DNA, 479 bp, Artificial
  TaSBEIIa allele with mutations introduced by TALEN pair TaSBEIIa_T03
  misc_feature (467): n is a or c or t or g
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctaggtcctggtgcctgacggcgagagcgacgacttggcaagtccggcgcaacctgaagaattacaggtacacacactcgtgccggtaaatcttcatacaatcgttattcacttaccaatgccggatgaaaccaccacggatgcgtcaggtttcgagcttcttctatcagcattgtgcagtactgcactgccttgttcattttgtagccttggccccgtgctggctnttgggccatgaa

SEQ ID NO: 9185 - DNA, 424 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgttcattttgttagccttggccccgtgctggctcttgggccactgaa

SEQ ID NO: 9186 - DNA, 485 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcgtcctggtgcctgacggcgagagcgacgacttggcaagtccggcgcaacctgaagaattacaggtacacacactcgtgccggtaaaatcttcatacaatcgttattcacttaccaaatgccggatgaaaccaaccacggaatgcgtcaggtttcgagcttcttctatcagcattgtgcagtactgcactgccttgttcatttgttagccttggccccgtgctggctcttgggtccgactgaa

SEQ ID NO: 9187 - DNA, 456 bp, Artificial
  TaSBEIIa allele with mutations introduced by TALEN pair TaSBEIIa_T03
gagagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctctgggccactgaa

SEQ ID NO: 9188 - DNA, 465 bp, Artificial; identical to SEQ ID NO: 8878
  TaSBEIIa allele with mutations introduced by TALEN pair TaSBEIIa_T03

SEQ ID NO: 9189 - DNA, 471 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccagggccaccacctgctccggggtcaagccgtgggcctggcacagcaccggcaacagccgctggacaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgt

SEQ ID NO: 9190 - DNA, 485 bp, Artificial; identical to SEQ ID NO: 8782
  TaSBEIIa allele with mutations introduced by TALEN pair TaSBEIIa_T03

SEQ ID NO: 9191 - DNA, 467 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttctattttgttagccttggccccgtgctggctcttgggccactgaa

SEQ ID NO: 9192 - DNA, 487 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 9193 - DNA, 489 bp, Artificial
  TaSBEIIa allele with mutations introduced by TALEN pair TaSBEIIa_T03
gagagatagctggattaggcgaatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaaggtcctggtgcctgacggcgagagcgacgacttggcaagtccggcgcaaacctgaagaattacaggtacacacactcgtgccggtaaatcttcatacaatcgttattcacttaccaaatgccggatgaaaaccaccacggatgcgtcaggtttcgagcttcttctatcagcattgtgcagtactgcactgccttgttcattttgttagccttggccccgtgctggctcttgggccactgaa

SEQ ID NO: 9194 - DNA, 479 bp, Artificial; identical to SEQ ID NO: 9018
  TaSBEIIa allele with mutations introduced by TALEN pair TaSBEIIa_T03

SEQ ID NO: 9195 - DNA, 486 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagtccttggccccgtgctggctcttgggccactgaa

SEQ ID NO: 9196 - DNA, 472 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcgacggcgagagcgacgacttggcaagtccggcgcaacctgaagaattacaggtacacacactcgtgccggtaaatcttcatacaatcgttattcacttaccaaatgccggatgaaaaccaaccacggatgcgtcaggtttccgagcttcttctatcagcattgtgcagtactgcactgccttgttcattttgttagccttggccccgtgctggctcttgggccactgaa

SEQ ID NO: 9197 - DNA, 487 bp, Artificial; identical to SEQ ID NO: 9085
  TaSBEIIa allele with mutations introduced by TALEN pair TaSBEIIa_T03

SEQ ID NO: 9198 - DNA, 485 bp, Artificial; identical to SEQ ID NO: 8903
  TaSBEIIa allele with mutations introduced by TALEN pair TaSBEIIa_T03

SEQ ID NO: 9199 - DNA, 479 bp, Artificial; identical to SEQ ID NO: 8842
  TaSBEIIa allele with mutations introduced by TALEN pair TaSBEIIa_T03

SEQ ID NO: 9200 - DNA, 480 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgtctattttgttagccttagccccgtgctggctcttgggccactgaa

SEQ ID NO: 9201 - DNA, 483 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccgcgcaacctgaagattacaggtacacacactcgtgccggtaaatcttcatacaatcgttatcacttaccaaatgccggatgaaacccaccacggatgcgtcaggtttcgagcttcttctatcagcattgtgcagtactgcactgccttgttcattttgttagccttggccccgtgctggctcttgggccactgaa

SEQ ID NO: 9202 - DNA, 484 bp, Artificial; identical to SEQ ID NO: 8845
  TaSBEIIa allele with mutations introduced by TALEN pair TaSBEIIa_T03

SEQ ID NO: 9203 - DNA, 485 bp, Artificial; identical to SEQ ID NO: 8782
  TaSBEIIa allele with mutations introduced by TALEN pair TaSBEIIa_T03

SEQ ID NO: 9204 - DNA, 479 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccatgcttccggctcgtatgttgtgtggaattgtgagcggataacaatttcacacaggaaggtcctggtgcctgacggtgagagcgacgacttggcaagtccggcgcaacctgaagaattacaggtacacaccatcgtgccgggaaatcgttcatacaatcgttattcacttaccaaatgccggatgaaaccaagccgcggaggcgtcaggttttgagcttcttctattcagcattgtgcagtactgcactgccttgtgcattttgtagtccgtggtccccg

SEQ ID NO: 9205 - DNA, 488 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagtccttggccccgtgctggctcttgggccactgaa

SEQ ID NO: 9206 - DNA, 506 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcaacgtcaaatttcccatacagagctaagggataatgcgtagcgttcacgtaactggaaggtcctggtgcctgacggcgagagcgacgacttggcaagtccggcgcaacctgaagaattacaggtacacacactcgtgcccggtaaatcttcatacaatcgttattcacttaccaaatgccggatgaaaccaaccacggatgcgtcaggtttcgagcttcttctatcagcattgtgcagtactgcactgccttgttcattttgt

SEQ ID NO: 9207 - DNA, 479 bp, Artificial; identical to SEQ ID NO: 8885
  TaSBEIIa allele with mutations introduced by TALEN pair TaSBEIIa_T03

SEQ ID NO: 9208 - DNA, 445 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgtagccgtggccccgttgcaggctcgttgggccacgtgaa

SEQ ID NO: 9209 - DNA, 485 bp, Artificial
  TaSBEIIa allele with mutations introduced by TALEN pair TaSBEIIa_T03
gaggatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 9210 - DNA, 485 bp, Artificial; identical to SEQ ID NO: 8807
  TaSBEIIa allele with mutations introduced by TALEN pair TaSBEIIa_T03

SEQ ID NO: 9211 - DNA, 493 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagcctcgcgaatgcatctagatccaatgatcatgagcggagaattaagggaaggtcctggtgcctgacggcgagagcgacgacttggcaagtccggcgcaacctgaagattacaggtacacacactcgtgccggtaaatcttcatacatcgttattcacttaccaaatgccggatgaaaccaaccacggatgcgtcaggtttcgagcttcttctatcagcattgtgcagtactgcactgccttgttctt

SEQ ID NO: 9212 - DNA, 483 bp, Artificial; identical to SEQ ID NO: 8895
  TaSBEIIa allele with mutations introduced by TALEN pair TaSBEIIa_T03

SEQ ID NO: 9213 - DNA, 507 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccatttcgtgtcgcgcgtttcggtgatgacggtgaaaacctctgacacatgcagctcccggacacggtcacagcttgtctgtaaggtcctggtgcctgacggcgagagcgacgacttggcaagtccggcgcaacctgaagaattacaggtacacacactcgtgccggtaaatcttcatacaatcgttattcacttaccaaatgaccggatgaaaccaaccacggatgcgtcaggtttcgagtcttcttctatcagcattgtgcgt

SEQ ID NO: 9214 - DNA, 485 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgtctattttgttagccttggccccgtgctggctcttgggccactgaa

SEQ ID NO: 9215 - DNA, 486 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgttgctggctcttgggccactgaa

SEQ ID NO: 9216 - DNA, 487 bp, Artificial; identical to SEQ ID NO: 8960
  TaSBEIIa allele with mutations introduced by TALEN pair TaSBEIIa_T03

SEQ ID NO: 9217 - DNA, 483 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggccaaggtcctggtgcctgacggcgagagcgacgacttggcaagtccggcgcaacctgaagaattacaggtacacacactcgtgccggtaaatcttcatacaatcgttattcacttaccaaatgccggatgaaaaccaaccacggatgcgtcaggtttcgagcttcttctatcagcattgtgcagtactgcactgccttgttcattttgttagccttggccccgtgcctggctcttgggccactgaa

SEQ ID NO: 9218 - DNA, 482 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccatacagcgtgagctatgagaaagcgccacgcttcccgaagggagaaaggcggaaggtcctggtgcctgacggtgagagcgacgacttggcaagtccggcgcaacctgaagaattacaggtacacaccatcgtgccgggaaatcgttcatacaatcgttattcacttaccaaatgccggatgaaaccaagccgcggaggcgtcaggttttgagcttcttctatcagcattgtgcagtactgcactgccttgtgcattttgttagccgtggccccgtgccgttgg

SEQ ID NO: 9219 - DNA, 436 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaaggtcctggtgcctggacggtgagagcgacgacttggcaagtccggcgcaacctgaagaattacaggtacacaccatcgtgccgggaaatcttcatacatcgttatcacttaccaatgccggatgaaccaagccgcggaggcgtcaggtttgagcttctctatcagcattgtgcagtactgcactgccttgtgcattttgtagccgtggccccgtgctggctcttgggccactgaa

SEQ ID NO: 9220 - DNA, 482 bp, Artificial; identical to SEQ ID NO: 9006
  TaSBEIIa allele with mutations introduced by TALEN pair TaSBEIIa_T03

SEQ ID NO: 9221 - DNA, 509 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggggatgtgctgcaaggcgattaagttgggtaacgccagggttttcccagtcacgacgaaggtcctggtgcctgacggcgagagcgacgacttggcaagtccggcgcaacctgaagaattacaggtacacacactcgtgccggtaaatcttcatacaatcgttatcacttaccaaatgccggatgaaaccaaccacggatgcgtcaggtttcgagcttcttctatcagcattgtgcagtactgcactgccttgtctattttgt

SEQ ID NO: 9222 - DNA, 485 bp, Artificial; identical to SEQ ID NO: 8782
  TaSBEIIa allele with mutations introduced by TALEN pair TaSBEIIa_T03

SEQ ID NO: 9223 - DNA, 488 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagccttggccccgtgctggctcttgggccactcgaa

SEQ ID NO: 9224 - DNA, 486 bp, Artificial; identical to SEQ ID NO: 8887
  TaSBEIIa allele with mutations introduced by TALEN pair TaSBEIIa_T03

SEQ ID NO: 9225 - DNA, 478 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggtcgttttttcactattgtagtcatccttgctattttgcaggcgccgtcctgagccgcgcgtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagccttggcccccgtgctggctcttgggccactgaa

SEQ ID NO: 9226 - DNA, 487 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttagggccactgaa

SEQ ID NO: 9227 - DNA, 475 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccagggccaccacctgctccggggtcaagccgtgggcctggcacagcaccggcaacagccgctggacaaggtcctggtgccctgacggtgagagcgacgacttggcaagtccggcgcaacctgaagaattacaggtacacaccatcgtgcccgggaaatcttcatacaatcgttattcacttaccaaatgccggatgaaaccaagccgcggaggcgtcaggttttgagcttcgttctatcagcattgtgcagtactgcactgccttgtgctattttgt

SEQ ID NO: 9228 - DNA, 485 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccccggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 9229 - DNA, 488 bp, Artificial; identical to SEQ ID NO: 9205
  TaSBEIIa allele with mutations introduced by TALEN pair TaSBEIIa_T03

SEQ ID NO: 9230 - DNA, 502 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggcccacggcttgaccccccagcaggtggtggccatcgccagcaataatggtggcaagcaggcgctggaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttctctatcagcattgtgcagtactgctac

SEQ ID NO: 9231 - DNA, 486 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgtagtccttggccccgtgctggctcttgggccactgaa

SEQ ID NO: 9232 - DNA, 484 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccgtcctggtgcctgacggcgagagcgacgacttggcaagtccggcgcaaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 9233 - DNA, 486 bp, Artificial; identical to SEQ ID NO: 8861
  TaSBEIIa allele with mutations introduced by TALEN pair TaSBEIIa_T03

SEQ ID NO: 9234 - DNA, 487 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctgggctcttgggccactgaa

SEQ ID NO: 9235 - DNA, 484 bp, Artificial; identical to SEQ ID NO: 9016
  TaSBEIIa allele with mutations introduced by TALEN pair TaSBEIIa_T03

SEQ ID NO: 9236 - DNA, 487 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaaccaaccacggatgcgtcaggtttcgagtcttcttctatcagcattgtgcagtactgcactgccttgttctattttgttagccttggccccgtgctggctcttgggcactgaa

SEQ ID NO: 9237 - DNA, 484 bp, Artificial; identical to SEQ ID NO: 8845
  TaSBEIIa allele with mutations introduced by TALEN pair TaSBEIIa_T03

SEQ ID NO: 9238 - DNA, 481 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctgtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagccttggccccgtgctggctcgttgggccactgaa

SEQ ID NO: 9239 - DNA, 481 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcctgggtgcctgacggcgagagcgacgacttggcaagtccggcgcaacctgaagaattacaggtacacacactcgtgccggtaaatcttcatacaatccgttattcacttaccaaatgccggatgaaaccaccacggatgcgtcaggtttcgagcttcttctatcagcattgtgcagtactgcactgccttgttcattttgttagcctttggccccgtgctggctcttgggccactgaa

SEQ ID NO: 9240 - DNA, 487 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaaggtcctggtgcctgacggcgagagcgacgacttggcaagtccggcgcaacctgaagaattacaggtacacacactcgtgccggtaaatcttcatacaatcgtattcacttaccaaatgccggatgaaaccaaccacggatgcgtcaggtttcgagcttcttctatcagcattgtgcagtactgcactgccttgttcattttgttagtccttggccccgtgctggctcttgggccactgaa

SEQ ID NO: 9241 - DNA, 437 bp, Artificial
  TaSBEIIa allele with mutations introduced by TALEN pair TaSBEIIa_T03
gagagatagctggattaggcgatcgcctcaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 9242 - DNA, 481 bp, Artificial
  TaSBEIIa allele with mutations introduced by TALEN pair TaSBEIIa_T03
gagagatagctggattaggacgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgtagccttggccccgtgcctgggctcttgggccactgaa

SEQ ID NO: 9243 - DNA, 479 bp, Artificial
  TaSBEIIa allele with mutations introduced by TALEN pair TaSBEIIa_T03
gagagatagctggattaggcgatcgcgcttcctgaacctgtatttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccgtcctggtgcctgacggcgagagcgacgacttggcaagtccggcgcaacctgaagaattacaggtacacacactcgtgccggtaaatcttcatacaatcgttatcacttaccaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 9244 - DNA, 486 bp, Artificial; identical to SEQ ID NO: 8770
  TaSBEIIa allele with mutations introduced by TALEN pair TaSBEIIa_T03

SEQ ID NO: 9245 - DNA, 505 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccatttcgtgtcgcgcgtttcggtgatgacggtgaaaacctctgacacatgcagctcccggacacggtcacagcttgtctgtaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccaacggatgcgtcaggttcgagcttcttctatcagcattcgtgct

SEQ ID NO: 9246 - DNA, 442 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 9247 - DNA, 488 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaaccaaccacggatgcgtcaggtttcgagcttcttctatcagcattgtgcagtactgcactgccttgttctattttgttagccttggccccgtgctggctcttgggccactgaa

SEQ ID NO: 9248 - DNA, 485 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggttcgagcttcttctatcagcattgtgcagtactgcactgccttgttcattttgttagccttggccccgtgctggctcttgggccactgaa

SEQ ID NO: 9249 - DNA, 441 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctcgtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgttagccgtggccccgtgctggctcgttgggccacgtgaa

SEQ ID NO: 9250 - DNA, 488 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcattccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaaccaaccacggatgcgtcaggtttcgagcttcttctatcagcattgtgcagtactgcactgccttgttcattttgttagccttggccccgtgctggctcttgggaccactgaa

SEQ ID NO: 9251 - DNA, 485 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtaacattgtctcactattgtagtcatccttgcattgcaggcgccgtcctgagccgcgcggcctctccaggcggcgagatgatcaaggccggcaccctgaccctggaggaggtgaggaggaagttcaacaacggcgagatcaacttcgcggccgactgataactcgagaagggcgcgatcgttcaaacatttggcaatgaaggtcctggtgcctgacggtgagagcgacgacttggcaagtccggcgcaacctgaagaattacaggtacacaccatcgtgccgggaaatcttcatacaatcgttattcacttaccaaatgccggatgaaacagacgcggaggcgcgtaggttgt

SEQ ID NO: 9252 - DNA, 481 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccctggtgcctgacggcgagagcgacgacttggcaagtccggcgcaaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 9253 - DNA, 483 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctgtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgttgctgggctcttgggccactgaa

SEQ ID NO: 9254 - DNA, 485 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcgtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagtccttggccccgttgcctggctcttgggccactgaa

SEQ ID NO: 9255 - DNA, 415 bp, Artificial
  TaSBEIIa allele with mutations introduced by TALEN pair TaSBEIIa_T03
gagagatagctggattaggcgatcgcctcaggccctggtgttaccacggctttgatcatctcctcctttcatgctgatattttctcactctttcttctgttcttgctgtaactgcaagttgtggcgttttttcactattgtagtcatccttgcattttgcaggcgccgtcctgagccgcgcggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 9256 - DNA, 488 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaaccaaccacggatgcgtcaggtttcgagcttcttctatcagcaattgtgcagtactgcactgccttgttcattttgttagccttggccccgtgctggctcttgggccactgaa

SEQ ID NO: 9257 - DNA, 490 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtccctggtgcctgacggcgagagcgacgacttggcaagtccggcgcaacctgaagaattacaggtacacacactcgtgccggtaaatcttcatacaatcgttattcacttaccaaatgccggatgaaaaccaaccacggatgcgtcaggtttcgagcttcttctatcagcattgtgcagtactgcactgccttgttctattttgttagtccttggcccccgtgctggctcttgggccactgaa

SEQ ID NO: 9258 - DNA, 487 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggcccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggcctactgaa

SEQ ID NO: 9259 - DNA, 486 bp, Artificial; identical to SEQ ID NO: 8779
  TaSBEIIa allele with mutations introduced by TALEN pair TaSBEIIa_T03

SEQ ID NO: 9260 - DNA, 483 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttatcacttacaaatgccggatgaaaccacacggatgcgtcaggtttcgagcttcttctatcagcattgtgcagtactgcactgccttgttcattttgttagccttggccccgtgcctggctcttgggccactgaa

SEQ ID NO: 9261 - DNA, 484 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 9262 - DNA, 452 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcgcgacgacttggcaagtccggcgcaacctgaagaattacaggtacacacactcgtgccggtaaatcttcatacaatcgttatcacttaccaaatgccggatgaaaccaccacggatgcgtcaggtttcgagcttctctatcagcattgtgcagtactgcactgccttgttcattttgttagccttggccccgtgctggctcttgggccactgaa

SEQ ID NO: 9263 - DNA, 505 bp, Artificial
  TaSBEIIa allele with mutations introduced by TALEN pair TaSBEIIa_T03
  misc_feature (452): n is a or c or t or g
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcacagcttgtctgtaagcggatgccgggagccgcgccctgacgggcttgtctgctcccgggaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggangcgtcaggtttcgagcttcttctatcagcattgtgcagtactgcactgccttt

SEQ ID NO: 9264 - DNA, 473 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgtagccttggccccgtgctggctcttgggccactgaa

SEQ ID NO: 9265 - DNA, 466 bp, Artificial
  TaSBEIIa allele with mutations introduced by TALEN pair TaSBEIIa_T03
  misc_feature (455): n is a or c or t or g
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctcaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggtttgagcttcttctatcagcattgtgcagtactgcactgccttgtgcattttgtagccgtggccccgtgctggctctgggccactgaactgaactgccaaggcacncaggggatagg

SEQ ID NO: 9266 - DNA, 480 bp, Artificial; identical to SEQ ID NO: 8892
  TaSBEIIa allele with mutations introduced by TALEN pair TaSBEIIa_T03

SEQ ID NO: 9267 - DNA, 489 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcaccccaggcccctggtgttaccacggctttgatcattcctcgtttcattctgatatatattttctcactctttttcttcctgttcttgctgtaactgcaagttgtggcgttttttcacttattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaaccaaccacggatgcgtcaggtttcgagcttcttctatcagcattgtgcagtactgcactgccttgttcattttgttagccttggccccgtgctggctcttgggccactgaa

SEQ ID NO: 9268 - DNA, 488 bp, Artificial
  TaSBEIIa allele with mutations introduced by TALEN pair TaSBEIIa_T03
gagagatagctggattaggcgatcgcgcttcctgaacctgttattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagtccttggccccgtgctggctcgttgggccactgaa

SEQ ID NO: 9269 - DNA, 484 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccggtcctggtgcctgacggcgagagcgacgacttggcaagtccggcgcaacctgaagaattacaggtacacacactcgtgccggtaaatcttcatacaatcgttattcacttaccaaatgccggatgaaaaccaaccacggatgcgtcaggtttcgagcttcttctatcagcattgtgcagtactgcactgccttgttcatttgttagccttggccccgtgctggctcttgggccactgaa

SEQ ID NO: 9270 - DNA, 489 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggcccccgtgctgggtctcgttgggcccactgaa

SEQ ID NO: 9271 - DNA, 484 bp, Artificial; identical to SEQ ID NO: 9136
  TaSBEIIa allele with mutations introduced by TALEN pair TaSBEIIa_T03

SEQ ID NO: 9272 - DNA, 482 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctaggtcctggtgcctgacggcgagagcgacgacttggcaagtccggcgcaacctgaagaattacaggtacacacactcgtgccggtaaatcttcatacaatcgttattcacttaccaaatgccggatgaaaaccaccacggatgcgtcaggtttcgagcttcttctatcagcattgtgcagtactgcactgccttgttcatttgttagccttggccccgtgctggctcttgggccactgaa

SEQ ID NO: 9273 - DNA, 509 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagagtaggccttggtgtccacgatcacgccgacggggagtcaggcaactatggatgaacgaaatagaaggtcctggtgcctgacggcgagagcgacgacttggcaagtccggcgcaaacctggaaagaattacagggtacacacactcgtgccggtaaatcttcatacaatcgttattcacttaccaaatgccggatgaaaccaacacggatgcgtcaggtttcgagcttcttctatcagcattgtgcagtactgcactgccttt

SEQ ID NO: 9274 - DNA, 487 bp, Artificial
  TaSBEIIa allele with mutations introduced by TALEN pair TaSBEIIa_T03
  misc_feature (335): n is a or c or t or g
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaaggtcctggtgcctgacggcgagagcgacgacttggcaagtccggcgcaacctgaagaattacaggtacacacactcgtgccggtaaancttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 9275 - DNA, 491 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcccacggcttgaccccggagcaggtggtggccatcgccagccacgatggcggcaagcaggcgctggagacggaaggtcctggtgcctgacggcgagagcgacgacttggcaagtccggcgcaacctgaagattacaggtacacacactcgtgccggtaaatcttcatacaatcgttattcacttaccaaatgccggatgaaaccaaccacggatgcgtcaggtttcgagcttcttctatcagcattgtgcagta

SEQ ID NO: 9276 - DNA, 486 bp, Artificial; identical to SEQ ID NO: 8779
  TaSBEIIa allele with mutations introduced by TALEN pair TaSBEIIa_T03

SEQ ID NO: 9277 - DNA, 486 bp, Artificial; identical to SEQ ID NO: 8779
  TaSBEIIa allele with mutations introduced by TALEN pair TaSBEIIa_T03

SEQ ID NO: 9278 - DNA, 482 bp, Artificial
  TaSBEIIa allele with mutations introduced by TALEN pair TaSBEIIa_T03
gagagatagctggataggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttatcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 9279 - DNA, 465 bp, Artificial
  TaSBEIIa allele with mutations introduced by TALEN pair TaSBEIIa_T03
gagagatagctggattaggcgatcgcgcttcctgaacctgttattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccgagagcgacgacttggcaagtccggcgcaacctgaagaattacaggtacacacactcgtgcccggtaaatcttcatacaatcgttattcacttaccaaatgccggatgaaaccaccacggatgcgtcaggtttcgagcttcttctatcagcattgtgcagtactgcactgccttgttcatttgttagccttggccccgtgctggctcttgggccactgaa

SEQ ID NO: 9280 - DNA, 485 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctctggccactgaa

SEQ ID NO: 9281 - DNA, 484 bp, Artificial; identical to SEQ ID NO: 8845
  TaSBEIIa allele with mutations introduced by TALEN pair TaSBEIIa_T03

SEQ ID NO: 9282 - DNA, 488 bp, Artificial; identical to SEQ ID NO: 9114
  TaSBEIIa allele with mutations introduced by TALEN pair TaSBEIIa_T03

SEQ ID NO: 9283 - DNA, 487 bp, Artificial; identical to SEQ ID NO: 8822
  TaSBEIIa allele with mutations introduced by TALEN pair TaSBEIIa_T03

SEQ ID NO: 9284 - DNA, 487 bp, Artificial; identical to SEQ ID NO: 8912
  TaSBEIIa allele with mutations introduced by TALEN pair TaSBEIIa_T03

SEQ ID NO: 9285 - DNA, 482 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctcttcctggtgcctgacggcgagagcgacgacttggcaagtccggcgcaacctgaagaattacaggtacacacactcgtgccggtaaaatcttcatacaatcgttattcacttaccaaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 9286 - DNA, 488 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctcttgggaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 9287 - DNA, 483 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatcccttgcattttgcaggcgccgtcctgagccgcgcggccaaggtcctggtgcctgacggcgagagcgacgacttggcaagtccggcgcaacctgaagaattacaggtacacacactcgtgccggtaaatcttcatacaatcgttattcacttaccaaatgccggatgaaaaccaaccacggatgcgtcaggtttcgagcttcttctatcagcattgtgcagtactgcactgccttgttcattttgttagccttggccccgtgctggctcttgggccactgaa

SEQ ID NO: 9288 - DNA, 486 bp, Artificial; identical to SEQ ID NO: 8818
  TaSBEIIa allele with mutations introduced by TALEN pair TaSBEIIa_T03

SEQ ID NO: 9289 - DNA, 489 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagtccttggccccgtgctggctcttcgggccactgaa

SEQ ID NO: 9290 - DNA, 489 bp, Artificial
  TaSBEIIa allele with mutations introduced by TALEN pair TaSBEIIa_T03
gagagatagctggattaggcgatcgcgcttcctgaacctgttattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaaggtcctggtgcctgacggcgagagcgacgacttggcaagtccggcgcaacctgaagaattacaggtacacacactcgtgccggtaaatcttcatacaatcgttattcacttaccaaatgccggatgaaaaccaaccacggatgcgtcaggtttcgagcttcttctatcagcattgtgcagtactgcactgccttgttcattttgttagccttggccccgtgctggctcttgggccactgaa

SEQ ID NO: 9291 - DNA, 453 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcgcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcatttgttagccttggccccgtgctggctcttgggccactgaa

SEQ ID NO: 9292 - DNA, 486 bp, Artificial
  TaSBEIIa allele with mutations introduced by TALEN pair TaSBEIIa_T03
gagagatagctggattaggcgatcgcgcttcctgaacctgtatttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagtccttggccccgtgctggctcttgggccactgaa

SEQ ID NO: 9293 - DNA, 486 bp, Artificial; identical to SEQ ID NO: 8779
  TaSBEIIa allele with mutations introduced by TALEN pair TaSBEIIa_T03

SEQ ID NO: 9294 - DNA, 489 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaaccaaccacggatgcgtcaggtttcgagcttcttctatcagcattgtgcagtactgcactgccttgttctattttgttagtccttggccccgtgcctggctcttgggccactgaa

SEQ ID NO: 9295 - DNA, 456 bp, Artificial
  TaSBEIIa allele with mutations introduced by TALEN pair TaSBEIIa_T03
gagagatagctggattaggcgatcgcgcttcctgaacctgtattttttcccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctcttcgactttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 9296 - DNA, 488 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagccttggccccgtgctgggctcttgggccactgaa

SEQ ID NO: 9297 - DNA, 481 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccgtcctggtgcctgacggcgagagcgacgacttggcaagtccggcgcaacctgaagaattacaggtacacacactcgtgccggtaaatcttcatacaatcgttattcacttaccaatgccggatgaaaccaaccacggatgcgtcaggtttcgagcttcttctatcagcattgtgcagtactgcactgccttgttcattttgttagccttggccccgtgctggctctggccgactgaa

SEQ ID NO: 9298 - DNA, 486 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagtccttggccccgtgctggctcttgggccactgaa

SEQ ID NO: 9299 - DNA, 470 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttctctatcagcattgtgcagtactgcactgccttgttcattttgttagccttggccccgtgctggctcttgggccactgaa

SEQ ID NO: 9300 - DNA, 484 bp, Artificial; identical to SEQ ID NO: 8867
  TaSBEIIa allele with mutations introduced by TALEN pair TaSBEIIa_T03

SEQ ID NO: 9301 - DNA, 487 bp, Artificial
  TaSBEIIa allele with mutations introduced by TALEN pair TaSBEIIa_T03
gagagatagctggattaggcgatcgcgcttcctgaacctgttattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 9302 - DNA, 482 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctcaaggtcctggtgcctgacggcgagagcgacgacttggcaagtccggcgcaacctgaagaattacaggtacacacactcgtgccggtaaatcttcatacaatcgttattcacttaccaaatgccgatgaaaccaacacggatgcgtcaggtttcgagcttcttctatcagcattgtgcagtactgcactgccttgttcattttgttagccttggccccgtgctggctcttgggccacgtgaa

SEQ ID NO: 9303 - DNA, 485 bp, Artificial; identical to SEQ ID NO: 8782
  TaSBEIIa allele with mutations introduced by TALEN pair TaSBEIIa_T03

SEQ ID NO: 9304 - DNA, 485 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatccttcatacaatcgttattcacttaccaaatgccggatgaaaccaaccacggatgcgtcagtttcgagcttcttctatcagcattgtgcagtactgcactgccttgttcattttgttagccttggccccgtgctggctcttgggccactgaa

SEQ ID NO: 9305 - DNA, 437 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccgtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgtagccttggccccgtgctggctcttgggccactgaa

SEQ ID NO: 9306 - DNA, 504 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggcccacggcttgaccccccagcaggtggtggccatcgccagcaataatggtggcaagcaggcgctggaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgctacg

SEQ ID NO: 9307 - DNA, 477 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcctgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagccttggccccgtgctggctcttgggccactgaa

SEQ ID NO: 9308 - DNA, 486 bp, Artificial; identical to SEQ ID NO: 8875
  TaSBEIIa allele with mutations introduced by TALEN pair TaSBEIIa_T03

SEQ ID NO: 9309 - DNA, 478 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcctggtgcctgacggcgagagcgacgacttggcaagtccggcgcaacctgaagaattacaggtacacacactcgtgccggtaaatcttcatacaatcgttatcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 9310 - DNA, 487 bp, Artificial; identical to SEQ ID NO: 8931
  TaSBEIIa allele with mutations introduced by TALEN pair TaSBEIIa_T03

SEQ ID NO: 9311 - DNA, 484 bp, Artificial
  TaSBEIIa allele with mutations introduced by TALEN pair TaSBEIIa_T03
gagagatagctggattaggcgatcgcgcttactgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 9312 - DNA, 483 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcaggtcctggtgcctgacggcgagagcgacgacttggcaagtccggcgcaacctgaagaattacaggtacacacactcgtgccggtaaatcttcatacaatcgttattcattaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 9313 - DNA, 486 bp, Artificial; identical to SEQ ID NO: 8861
  TaSBEIIa allele with mutations introduced by TALEN pair TaSBEIIa_T03

SEQ ID NO: 9314 - DNA, 500 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccatttcgtgtcgcgcgtttcggtgatgacggtgaaaacctctgacacatgcagctcccggacacggtcacaggcttgtctgtaaggtcctggtgcctgacggcgagagcgacgacttggcaagtccggcgcaacctgaagattacaggtacacacactcgtgccggtaaatcttcatacaatcgttattcacttaccaatgccggatgaaccacacggatgcgtcaggtttcgagcttcttctatcagcattgtgct

SEQ ID NO: 9315 - DNA, 490 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagtccttggccccgttgctggctcgttgggacactgaa

SEQ ID NO: 9316 - DNA, 487 bp, Artificial; identical to SEQ ID NO: 8806
  TaSBEIIa allele with mutations introduced by TALEN pair TaSBEIIa_T03

SEQ ID NO: 9317 - DNA, 442 bp, Artificial; identical to SEQ ID NO: 9246
  TaSBEIIa allele with mutations introduced by TALEN pair TaSBEIIa_T03

SEQ ID NO: 9318 - DNA, 486 bp, Artificial; identical to SEQ ID NO: 8844
  TaSBEIIa allele with mutations introduced by TALEN pair TaSBEIIa_T03

SEQ ID NO: 9319 - DNA, 487 bp, Artificial; identical to SEQ ID NO: 8822
  TaSBEIIa allele with mutations introduced by TALEN pair TaSBEIIa_T03

SEQ ID NO: 9320 - DNA, 488 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgtccttgttcattttgttagtccttggccccgtgctggctcttgggccactgaa

SEQ ID NO: 9321 - DNA, 486 bp, Artificial; identical to SEQ ID NO: 8818
  TaSBEIIa allele with mutations introduced by TALEN pair TaSBEIIa_T03

SEQ ID NO: 9322 - DNA, 486 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttctattttgttagccttggccccgtgctggctcgttgggccactgaa

SEQ ID NO: 9323 - DNA, 485 bp, Artificial; identical to SEQ ID NO: 8862
  TaSBEIIa allele with mutations introduced by TALEN pair TaSBEIIa_T03

SEQ ID NO: 9324 - DNA, 493 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtagcattgtctcactattgtagtcatccttgcattgcaggcgccgtcctgagccgcgcggcctctccatacagcgtgagctatgagaaagcgccacgcttcccgaagggagaaaggcggaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggtttgagcttcttctatcagcattgtgcagtactgcactgccttgtgt

SEQ ID NO: 9325 - DNA, 487 bp, Artificial
  TaSBEIIa allele with mutations introduced by TALEN pair TaSBEIIa_T03
gagagatagctggattaggcgatcgcgcttcctgaacctgttattttttccccgcggggaaatgcgttagtgtcacccacggccctggtgttaccacggctttgatcattcctcgtttcattctgatatatattttctcactctttttcttcctgttcttgctgtaactgcaagttgtggcgttttttcactattgtagtcattccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 9326 - DNA, 486 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattaccaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgtagccttggccccgtgctggctcttgggccactgaa

SEQ ID NO: 9327 - DNA, 516 bp, Artificial
  TaSBEIIa allele with mutations introduced by TALEN pair TaSBEIIa_T03
  misc_feature (350): n is a or c or t or g
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggatcttaccgctgttgagatccagttcgatgtaacccactcgtgcacccaactgatcttcagcatcttttactttcaccagcgtttctgggtgagcaaaaaacnggaaggcaaaatgaccgcaggtcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgttcg

SEQ ID NO: 9328 - DNA, 487 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcataccaatcgttattcacttaccaaatgccggatggaaaccaaccacggatgcgtcaggtttcgagcttcttctatcagcattgtgcagtactgcactgccttgttcattttgttagccttggccccgtgctggctctgggccactgaa

SEQ ID NO: 9329 - DNA, 481 bp, Artificial; identical to SEQ ID NO: 9023
  TaSBEIIa allele with mutations introduced by TALEN pair TaSBEIIa_T03

SEQ ID NO: 9330 - DNA, 489 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgtacgtccttggtccccgtgctggctcttgggccactgaa

SEQ ID NO: 9331 - DNA, 486 bp, Artificial; identical to SEQ ID NO: 8779
  TaSBEIIa allele with mutations introduced by TALEN pair TaSBEIIa_T03

SEQ ID NO: 9332 - DNA, 487 bp, Artificial; identical to SEQ ID NO: 8822
  TaSBEIIa allele with mutations introduced by TALEN pair TaSBEIIa_T03

SEQ ID NO: 9333 - DNA, 478 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcctggtgcctgacggcgagagcgacgacttggcaagtccggcgcaacctgaagaattacaggtacacacactcgtgccggtaaatcttcatacaatcgttatcacttaccaatgccggatgaaaccaccacggatgcgtcaggtttcgagcttcttctatcagcattgtgcagtactgcactgccttgttctattttgttagtccttggccccgtgctggctcttgggccactgaa

SEQ ID NO: 9334 - DNA, 479 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgtagccttggccccgtgctggctcttgggccactgaa

SEQ ID NO: 9335 - DNA, 488 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctctggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgtccttgttcattttgttagtccttgggccccgtgctggctcgttgggccactgaa

SEQ ID NO: 9336 - DNA, 486 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacgactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 9337 - DNA, 441 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaaggtcctggtgcctgacggtgagagcgacgacttggcaagtccggcgcaacctgaagaattacaggtacacaccatcgtgccgggaaatcttcatacaatcgttattcacttaccaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 9338 - DNA, 481 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccgtcctggtgcctgacggcgagagcgacgacttggcaagtccggcgcaacctgaagaattacaggtacacacactcgtgccggtaaatcttcatacaatcgttattcacttaccaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 9339 - DNA, 488 bp, Artificial
  TaSBEIIa allele with mutations introduced by TALEN pair TaSBEIIa_T03
gagagatagctggattaggcgatcgcgcttcctgaacctgtattttttccccgtcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagccttggccccgtgctggctcttgggccactgaa

SEQ ID NO: 9340 - DNA, 486 bp, Artificial; identical to SEQ ID NO: 8779
  TaSBEIIa allele with mutations introduced by TALEN pair TaSBEIIa_T03

SEQ ID NO: 9341 - DNA, 487 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagtccttggccccgtgctggctcgttgggccactgaa

SEQ ID NO: 9342 - DNA, 464 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgtagccttggccccgtgctggctcttgggccactgaa

SEQ ID NO: 9343 - DNA, 488 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtaccacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagccttggccccgtgctggctcttgggccactgaa

SEQ ID NO: 9344 - DNA, 485 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctctggtcctggtgcctgacggcgagagcgacgacttggcaagtccggcgcaacctgaagaattacaggtacacacactcgtgccggtaaatcttcatacaatcgttattcacttaccaaatgccggatgaaaacccaaccacggatgcgtcaggtttcgagcttcttctatcagcattgtgcagtactgcactgccttgttcattttgttagccttggccccgtgctggctcttgggccactga

SEQ ID NO: 9345 - DNA, 486 bp, Artificial; identical to SEQ ID NO: 8779
  TaSBEIIa allele with mutations introduced by TALEN pair TaSBEIIa_T03

SEQ ID NO: 9346 - DNA, 502 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagcgcacgagggagcttccagggggaaacgcctggaaggtcctggtgcctgacggcgagagcgacgacttggcaagtccggcgcaacctgaagattacaggtacacacactcgtgccggtaaatcttcatacaatcgttattcacttaccaaatgctggatgaaaccaccacggatgcgtcaggtttcgagcttcttctatcagcattgtgcagtactgcactgccttgttcattttgtagccttggccccgtgctgg

SEQ ID NO: 9347 - DNA, 510 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcgaacgaaccttcggtttgatcttctcctgttgctgctggctgtagccgatcgataaggagaccgccgctgccaagttcgagagacagcacatggacaaggtcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagtcttcttt

SEQ ID NO: 9348 - DNA, 485 bp, Artificial; identical to SEQ ID NO: 8782
  TaSBEIIa allele with mutations introduced by TALEN pair TaSBEIIa_T03

SEQ ID NO: 9349 - DNA, 487 bp, Artificial; identical to SEQ ID NO: 9066
  TaSBEIIa allele with mutations introduced by TALEN pair TaSBEIIa_T03

SEQ ID NO: 9350 - DNA, 473 bp, Artificial
  TaSBEIIa allele with mutations introduced by TALEN pair TaSBEIIa_T03
gagagatagctggattaggcgatcgcgcttcctgaacctgtattttttcccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 9351 - DNA, 496 bp, Artificial
  TaSBEIIa allele with mutations introduced by TALEN pair TaSBEIIa_T03
  misc_feature (490): n is a or c or t or g
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggcccacggcttgaccccccagcaggtggtggccatcgccagcaataatggtggcaagcaggcgctggaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgngcagta

SEQ ID NO: 9352 - DNA, 509 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagcgcacgagggagcttccagggggaaacgcctggaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgtagccttggccccgtgctggctctt

SEQ ID NO: 9353 - DNA, 485 bp, Artificial; identical to SEQ ID NO: 8782
  TaSBEIIa allele with mutations introduced by TALEN pair TaSBEIIa_T03

SEQ ID NO: 9354 - DNA, 454 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcgcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgatggctcttgggccactgaa

SEQ ID NO: 9355 - DNA, 488 bp, Artificial; identical to SEQ ID NO: 8899
  TaSBEIIa allele with mutations introduced by TALEN pair TaSBEIIa_T03

SEQ ID NO: 9356 - DNA, 458 bp, Artificial
  TaSBEIIa allele with mutations introduced by TALEN pair TaSBEIIa_T03
gagagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcattttgcaggcgccgtcctgagccgcgcggcctctccaaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 9357 - DNA, 485 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcgttgggccactgaa

SEQ ID NO: 9358 - DNA, 487 bp, Artificial; identical to SEQ ID NO: 8931
  TaSBEIIa allele with mutations introduced by TALEN pair TaSBEIIa_T03

SEQ ID NO: 9359 - DNA, 481 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccctggtgcctgacggcgagagcgacgacttggcaagtccggcgcaacctgaagaattacaggtacacacactcgtgccggtaaatcttcatacaatcgttattcacttaccaaatgccggatgaaaccaaccacgggatgcgtcaggtttcgagcttcttctatcagcattgtgcagtactgcactgccttgttcattttgttagccttggccccgtgctggctcttgggccactgaa

SEQ ID NO: 9360 - DNA, 473 bp, Artificial; identical to SEQ ID NO: 9264
  TaSBEIIa allele with mutations introduced by TALEN pair TaSBEIIa_T03

SEQ ID NO: 9361 - DNA, 488 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatatttctcactctttttcttcctgttcttgctgtaactgcaagttgtggcgttttttcactattgtagtcatccttgcattttgcaggcgccgtcctgagccgcgcggcctctccagggtcctggtgcctgacggcgagagcgacgacttggcaagtccggcgcaacctgaagaattacaggtacacacactcgtgccggtaaaatcttcatacaatcgttattcacttaccaaatgccggatgaaaaccaaccacggatgcgtcaggtttcgagcttcttctatcagcattgtgcagtactgcactgccttgttcatttttgttagccttggccccgtgctggctcttgggcacctgaa

SEQ ID NO: 9362 - DNA, 484 bp, Artificial; identical to SEQ ID NO: 8867
  TaSBEIIa allele with mutations introduced by TALEN pair TaSBEIIa_T03

SEQ ID NO: 9363 - DNA, 487 bp, Artificial; identical to SEQ ID NO: 8912
  TaSBEIIa allele with mutations introduced by TALEN pair TaSBEIIa_T03

SEQ ID NO: 9364 - DNA, 485 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttatcacttaccaaatgccggatgaaaccaaccacggatgcgtcaggtttcgagcttcttctatcagcattgtgcagtactgcactgccttgttcattttgtagtccttggccccgtgctggctcttgggccactgaa

SEQ ID NO: 9365 - DNA, 499 bp, Artificial; identical to SEQ ID NO: 9139
  TaSBEIIa allele with mutations introduced by TALEN pair TaSBEIIa_T03

SEQ ID NO: 9366 - DNA, 489 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaaggtcctggtgcctgacggcgagagcgacgacttggcaagtccggcgcaacctgaagaattacaggtacacacactcgtgccggtaaatcttcatacaatcgttattcacttaccaaatgccggatgaaaaccaaccacggatgcgtcaggtttcgagcttcttctatcagcattgtgcagtactgcactgccttgttcattttgttagtccttggccccgtgctggctcttgggccactgaa

SEQ ID NO: 9367 - DNA, 487 bp, Artificial; identical to SEQ ID NO: 9192
  TaSBEIIa allele with mutations introduced by TALEN pair TaSBEIIa_T03

SEQ ID NO: 9368 - DNA, 487 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaaggtcctggtgcctgacggcgagagcgacgacttggcaagtccggcgcaacctgaagaattacaggtacacacactcgtgccggtaaatcttcatacaatcgttaattcacttaccaaatgccggatgaaaacccacacggatgcgtcaggtttcgagcttcttctatcagcattgtgcagtactgcactgccttgttcattttgtagccttggccccgtgctggctcttgggccactgaa

SEQ ID NO: 9369 - DNA, 488 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgcctggctcttgggccactgaa

SEQ ID NO: 9370 - DNA, 489 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattccttcgttttcattctgatatatattttctcactctttttcttcctgttcttgctgtaactgcaagttgtggcgttttttcactattgtagtcatccttgcattttgcaggcgccgtcctgagccgcgcggcctctccaaaggtcctggtgcctgacggcgagagcgacgacttggcaagtccggcgcaaacctgaagaattacaggtacacacactcgtgccggtaaaatcttcatacaatcgttattcacttaccaaatgccggatgaaaccaccacggatgcgtcaggtttcgagcttcttctatcagcattgtgcagtactgcactgccttgttcattttgtagccttggccccgtgctggctcttgggccactgaa

SEQ ID NO: 9371 - DNA, 484 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcaaggtcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 9372 - DNA, 504 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagagaaaataccgcatcaggcgccattcgccattcaggctgcgcaactgttgggaagggcgatcggtgcgggaaggtcctggtgcctgacggcgagagcgacgacttggcaagtccggcgcaacctgaagaattacaggtacacacactcgtgccggtaaatcttcatacaatcgttattcacttaccaaatgaccggatgaaaccaaccacggatgccgtcaggtttcgagcttcttctatcagcattgtgcagtactg

SEQ ID NO: 9373 - DNA, 486 bp, Artificial; identical to SEQ ID NO: 8818
  TaSBEIIa allele with mutations introduced by TALEN pair TaSBEIIa_T03

SEQ ID NO: 9374 - DNA, 487 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaaccaaccacggatgcgtcaggtttcgagcttcttctatcagcattgtgcagtactgcactgccttgttctattttgttagccttggccccgtgctggctcttgggccactga

SEQ ID NO: 9375 - DNA, 485 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctcaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatcgcgtcaggtttcgagctcttctatcagcattgtgcagtactgcactgccttgttctattttgttagtccttggccccgtgctggctcttgggccactgaa

SEQ ID NO: 9376 - DNA, 484 bp, Artificial
  TaSBEIIa allele with mutations introduced by TALEN pair TaSBEIIa_T03
  misc_feature (470): n is a or c or t or g
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaaggtcctggtgcctgacggcgagagcgacgacttggcaagtccggcgcaacctgaagaattacaggtacacacactcgtgccggtaaaatcttcatacaatcgttattcacttaccaaatgccggatgaaaccaacacggatgcgtcaggtttcgagcttcttctatcagcattgtgcagtactgcactgccttgtcatttgtagccttggccccgtgctggcncttgggccactgaa

SEQ ID NO: 9377 - DNA, 484 bp, Artificial
  TaSBEIIa allele with mutations introduced by TALEN pair TaSBEIIa_T03
gagagtagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 9378 - DNA, 488 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgaccggatgaaaccaacacggatgcgtcaggtttcgagcttcttctatcagcattgtgcagtactgcactgccttgttctattttgttagtccttggccccgtgctggctcttgggccactgaa

SEQ ID NO: 9379 - DNA, 458 bp, Artificial
  TaSBEIIa allele with mutations introduced by TALEN pair TaSBEIIa_T03
gagagatagcggattaggcgatcgcgcttcctgaacctgtattttttccccgcgggaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccacgactttggcaagtccggcgcaacctgaagaattacaggtacacacactcgtgccggtaaatcttcatacaatcgttattcacttaccaaatgccggatcgaaaccaaccacggatgcgtcaggtttcgagcttcttctatcagcattgtgcagtactgcactgccttgttcattttgttagccttggccccgtgcctggctcttgggccactgaa

SEQ ID NO: 9380 - DNA, 489 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagtccttggccccgtgctggctcttcgggccactgaa

SEQ ID NO: 9381 - DNA, 483 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgtattcacttaccaaatgccggatgaaaccaaccacggatgcgtcaggtttcgagcttcttctatcagcatgtgcagtactgcactgccttgttcatttgttagccttggccccgtgctggctcttgggccactgaa

SEQ ID NO: 9382 - DNA, 484 bp, Artificial; identical to SEQ ID NO: 8867
  TaSBEIIa allele with mutations introduced by TALEN pair TaSBEIIa_T03

SEQ ID NO: 9383 - DNA, 423 bp, Artificial; identical to SEQ ID NO: 8932
  TaSBEIIa allele with mutations introduced by TALEN pair TaSBEIIa_T03

SEQ ID NO: 9384 - DNA, 491 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaaagtccggcgcaaacctgaaagaattacaggtacacacactcgtgccggtaaaatcttcatacaatcgttattcacttaccaaatgccggatgaaaaccaaccacgggatgcgtcaggtttcgagcttcttctatcagcattgtgcagtactgcactgccttgttcattttgttagccttggccccgtgctggctcttgggccactgaa

SEQ ID NO: 9385 - DNA, 509 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggcgatggccaccacctgctccggggtcaagccgtgggaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagctcttctatcagcattgtgcagtactgcactgccttgttcattttgttagccttggccccgtgcctgg

SEQ ID NO: 9386 - DNA, 487 bp, Artificial; identical to SEQ ID NO: 8806
  TaSBEIIa allele with mutations introduced by TALEN pair TaSBEIIa_T03

SEQ ID NO: 9387 - DNA, 487 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctctggtcctggtgcctgacggcgagagcgacgacttggcaagtccggcgcaacctgaagaattacaggtacacacactcgtgccggtaaatcttcatacaatcgttattcacttaccaaatgccggatgaaaaccaaccacggatgcgtcaggtttcgagcttcttctatcagcattgtgcagtactgcactgccttgttctattttgttagtccttggccccgtgatggctcttgggccactgaa

SEQ ID NO: 9388 - DNA, 483 bp, Artificial; identical to SEQ ID NO: 8895
  TaSBEIIa allele with mutations introduced by TALEN pair TaSBEIIa_T03

SEQ ID NO: 9389 - DNA, 470 bp, Artificial
  TaSBEIIa allele with mutations introduced by TALEN pair TaSBEIIa_T03
gagagatagctggattaaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttctctatcagcattgtgcagtactgcactgccttgttcatttgttagccttggccccgtgctggctcttgggccactgaa

SEQ ID NO: 9390 - DNA, 485 bp, Artificial; identical to SEQ ID NO: 8903
  TaSBEIIa allele with mutations introduced by TALEN pair TaSBEIIa_T03

SEQ ID NO: 9391 - DNA, 471 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 9392 - DNA, 489 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagtccttcggccccgtgctggctcgttgggccactgaa

SEQ ID NO: 9393 - DNA, 479 bp, Artificial; identical to SEQ ID NO: 8885
  TaSBEIIa allele with mutations introduced by TALEN pair TaSBEIIa_T03

SEQ ID NO: 9394 - DNA, 479 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcctggtgcctgacggcgagagcgacgacttggcaagtccggcgcaacctgaagattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctgggctcttgggccactgaa

SEQ ID NO: 9395 - DNA, 486 bp, Artificial
  TaSBEIIa allele with mutations introduced by TALEN pair TaSBEIIa_T03
gagagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagtccttggccccgtgctggctcgttgggccactgaa

SEQ ID NO: 9396 - DNA, 484 bp, Artificial; identical to SEQ ID NO: 8791
  TaSBEIIa allele with mutations introduced by TALEN pair TaSBEIIa_T03

SEQ ID NO: 9397 - DNA, 488 bp, Artificial; identical to SEQ ID NO: 9093
  TaSBEIIa allele with mutations introduced by TALEN pair TaSBEIIa_T03

SEQ ID NO: 9398 - DNA, 486 bp, Artificial
  TaSBEIIa allele with mutations introduced by TALEN pair TaSBEIIa_T03
  misc_feature (381): n is a or c or t or g
gagagatagctggattaggcgatcgcgcttcctgaacctgtattttttcccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccncggatgcgtcaggtttcgagcttcttctatcagcattgtgcagtactgcactgccttgttcattttgttagcctttggccccgtgctggctcttgggcccatgaa

SEQ ID NO: 9399 - DNA, 483 bp, Artificial
  TaSBEIIa allele with mutations introduced by TALEN pair TaSBEIIa_T03
  misc_feature (25): n is a or c or t or g
gagagatagctggattaggcgatcncgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagtcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 9400 - DNA, 481 bp, Artificial
  TaSBEIIa allele with mutations introduced by TALEN pair TaSBEIIa_T03
gagagatagctggattaggcgatcgcgcttcctgaacctgttattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagcctttggccccgtgctggctcttgggccactgaa

SEQ ID NO: 9401 - DNA, 444 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgttagccgtggccccgtgctggctcttcgggccactgaa

SEQ ID NO: 9402 - DNA, 483 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttatcacttaccaaatgccggatgaaaccaaccacggatgcgtcaggtttcgagcttcttctatcagcattgtgcagtactgcactgccttgttcattttgtagccttggccccgtgctggctcttgggccactgaa

SEQ ID NO: 9403 - DNA, 485 bp, Artificial; identical to SEQ ID NO: 8903
  TaSBEIIa allele with mutations introduced by TALEN pair TaSBEIIa_T03

SEQ ID NO: 9404 - DNA, 486 bp, Artificial; identical to SEQ ID NO: 8779
  TaSBEIIa allele with mutations introduced by TALEN pair TaSBEIIa_T03

SEQ ID NO: 9405 - DNA, 484 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccacacggatgcgtcaggtttcgagcttcttctatcagcattgtgcagtactgcactgccttgttcattttgttagccttggccccgtgctggctcttgggccactgaa

SEQ ID NO: 9406 - DNA, 481 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccgtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcatttgtagccttggccccgtgctggctcttgggccactgaa

SEQ ID NO: 9407 - DNA, 486 bp, Artificial; identical to SEQ ID NO: 8779
  TaSBEIIa allele with mutations introduced by TALEN pair TaSBEIIa_T03

SEQ ID NO: 9408 - DNA, 486 bp, Artificial; identical to SEQ ID NO: 8779
  TaSBEIIa allele with mutations introduced by TALEN pair TaSBEIIa_T03

SEQ ID NO: 9409 - DNA, 483 bp, Artificial; identical to SEQ ID NO: 8895
  TaSBEIIa allele with mutations introduced by TALEN pair TaSBEIIa_T03

SEQ ID NO: 9410 - DNA, 488 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtagcagtactgcactgccttgttctattttgttagtccttggccccgtgctggctcttgggccactgaa

SEQ ID NO: 9411 - DNA, 485 bp, Artificial; identical to SEQ ID NO: 8782
  TaSBEIIa allele with mutations introduced by TALEN pair TaSBEIIa_T03

SEQ ID NO: 9412 - DNA, 489 bp, Artificial
  TaSBEIIa allele with mutations introduced by TALEN pair TaSBEIIa_T03
gagagatagctggattaggcgatcgcgcttcctgaacctgtattttttcccgcggggaaatgcgttagtgtcacccaggccctggtgttaccacggctttgatcattcctcgtttcattctgatatatattttctcactctttttctcctgttcttgctgtaactgcaagttgtggcgttttttcactattgtagtcatccttgcatttttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacgggatgcgtcaggtttcgagcttcttctatcagcattgtgcagtactgcactgccttgttcattttgttagtccttggccccgttgctgggctacttgggccactgaa

SEQ ID NO: 9413 - DNA, 450 bp, Artificial; identical to SEQ ID NO: 8968
  TaSBEIIa allele with mutations introduced by TALEN pair TaSBEIIa_T03

SEQ ID NO: 9414 - DNA, 487 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctatccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagtccttggccccgtgctggctcttgggccactgaa

SEQ ID NO: 9415 - DNA, 483 bp, Artificial; identical to SEQ ID NO: 8810
  TaSBEIIa allele with mutations introduced by TALEN pair TaSBEIIa_T03

SEQ ID NO: 9416 - DNA, 483 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagtcctggtgcctgacggcgagagcgacgacttggcaagtccggcgcaacctgaagaattacaggtacacacactcgtgccggtaaatcttcatacaatcgttattcacttaccaaatgccggatgaaaaccaccacggatgcgtcaggtttcgagcttcttctatcagcattgtgcagtactgcactgccttgttcattttgtagcttggccccgtgctggctcgttgggccactgaa

SEQ ID NO: 9417 - DNA, 486 bp, Artificial; identical to SEQ ID NO: 8779
  TaSBEIIa allele with mutations introduced by TALEN pair TaSBEIIa_T03

SEQ ID NO: 9418 - DNA, 487 bp, Artificial
  TaSBEIIa allele with mutations introduced by TALEN pair TaSBEIIa_T03
gagagatagctggattaggcgatcgcgcttcctgaacctgttattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaaccaccacggatgcgtcaggtttcgagcttcttctatcagcattgtgcagtactgcactgccttgttcattttgttagccttggccccgtgctggctcttgggccactgaa

SEQ ID NO: 9419 - DNA, 487 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggcccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 9420 - DNA, 478 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcctggtgcctgacggcgagagcgacgacttggcaagtccggcgcaacctgaagaattacaggtacacacactcgtgccggtaaatcttcatacaatcgttattcacttaccaaatgccggatgaaaccaacacggatgcgtcaggttcgagcttcttctatcagcattgtgcagtactgcactgccttgttcattttgttagccttggccccgtgctggctcttgggcctactgaa

SEQ ID NO: 9421 - DNA, 480 bp, Artificial; identical to SEQ ID NO: 8892
  TaSBEIIa allele with mutations introduced by TALEN pair TaSBEIIa_T03

SEQ ID NO: 9422 - DNA, 488 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaaggtcctggtgcctgacggcgagagcgacgacttggcaagtccggcgcaaacctgaagaattacaggtacacacactcgtgccggtaaatcttcatacaatcgttattcacttaccaaatgccggatgaaaccaaccacggatgcgtcaggtttcgagcttcttctatcagcaattgtgcagtactgcactgccttgttcatttgttagccttggccccgtgctggctcttgggccactgaa

SEQ ID NO: 9423 - DNA, 484 bp, Artificial; identical to SEQ ID NO: 9261
  TaSBEIIa allele with mutations introduced by TALEN pair TaSBEIIa_T03

SEQ ID NO: 9424 - DNA, 488 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcacttattgtagtcatccttgcattttgcaggcgccgtcctgagccgcgcggcctctccaggtcctggtgcctgacggcgagagcgacgacttggcaagtccggcgcaacctgaagaattacaggtacacgacactcgtgccggtaaatcttcatacaatcgttattcacttaccaaatgccggatgaaaaccaaccacggatgcgtcaggtttcgagcttcttctatcagcattgtgcagtactgcactgccttgttcattttgttagccttggccccgtgctggctcttgggccactgaa

SEQ ID NO: 9425 - DNA, 436 bp, Artificial
  TaSBEIIa allele with mutations introduced by TALEN pair TaSBEIIa_T03
gagagatagctggattaggcgatcgcctcaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgtagccttggccccgtgctggctcttgggccactgaa

SEQ ID NO: 9426 - DNA, 508 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccatttcgtgtcgcgcgtttcggtgatgacggtgaaaacctctgacacatgcagctcccggacacggtcacagcttgtctgtaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagtcttcttctatcagcattgtgctacg

SEQ ID NO: 9427 - DNA, 487 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaaggtcctggtgcctgacggcgagagcgacgacttggcaagtccggcgcaacctgaagaattacaggtacacacactcgtgccggtaaatcttcatacaatcgttattcacttaccaaatgccggatgaaaacccaaccacggatgcgtcaggtttcgagcttcttctatcagcattgtgcagtactgcactgccttgttcattttgttagccttggccccgtgctggctcttgggcactga

SEQ ID NO: 9428 - DNA, 509 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggtcaagccgtgggcctggcacagcaccggaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagtccttggccccgtgctggctcttc

SEQ ID NO: 9429 - DNA, 485 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttctattttgttagccttggccccgtgctggctcttgggccactgaa

SEQ ID NO: 9430 - DNA, 478 bp, Artificial
  TaSBEIIa allele with mutations introduced by TALEN pair TaSBEIIa_T03
  misc_feature (465): n is a or c or t or g
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccctggtgcctgacggcgagagcgacgacttggcaagtccggcgcaacctgaagaattacaggtacacacactcgtgccggtaaatcttcatacaatcgttatcacttacaaatgccggatgaaaccaaccacggatgcgtcaggtttcgagcttcttctatcagcattgtgcagtactgcactgccttgttcattttgttagccttggccccgtgctggctnttgggccactgaa

SEQ ID NO: 9431 - DNA, 486 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggcccccgtgcctggctcttgggccactgaa

SEQ ID NO: 9432 - DNA, 474 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctggtgcctgacggcgagagcgacgacttggcaagtccggcgcaacctgaagaattacaggtacacacactcgtgccggtaaatcttcatacaatcgttattcacttaccaaatgccggatgaaaccaacacggatgcgtcaggtttcgagcttcttctatcagcattgtgcagtactgcactgccttgttcattttgttagccttggcccccgtgctggctcttgggccactgaa

SEQ ID NO: 9433 - DNA, 483 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcaaggtcctggtgcctgacggcgagagcgacgacttggcaagtccggcgcaacctgaagattacaggtacacacactcgtgccggtaaatcttcatacaatcgtattcacttaccaaatgccggatgaaaccaaccacggatgcgtcaggtttcgagcttcttctatcagcattgtgcagtactgcactgccttgttcattttgttagccttggccccgtgctggcttctgggccactgaa

SEQ ID NO: 9434 - DNA, 480 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgtagccttggccccgtgctggctcttgggccactgaa

SEQ ID NO: 9435 - DNA, 343 bp, Artificial
  TaSBEIIa allele with mutations introduced by TALEN pair TaSBEIIa_T03
gagagatagctggattaggcgatcgcctgcgtcagtgtctacccaggccctggtgttatcacggctttgactcatctcctcctattctgattacttttctcacttctttcttctgttcttgtcttgtaactgctaagttgtaagctattgtctcactattgtagtctatccttgctattgcaggtcgccgtcctgacgccgcgcggcctctccaaggtcctggtgcctgacggtgagagcgacgacttggcaagtccggcgcaacctgaagaattacaggtacacaccatcgtgaccggaaatctcatacaatcgttatcacttacaatgcgatgaaccagcg

SEQ ID NO: 9436 - DNA, 439 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccgtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 9437 - DNA, 486 bp, Artificial
  TaSBEIIa allele with mutations introduced by TALEN pair TaSBEIIa_T03
gagagatagctggattaggcgatcgcgcttcctgaacctgttattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgtagccttggccccgtgctggctcttgggccactgaa

SEQ ID NO: 9438 - DNA, 486 bp, Artificial; identical to SEQ ID NO: 8779
  TaSBEIIa allele with mutations introduced by TALEN pair TaSBEIIa_T03

SEQ ID NO: 9439 - DNA, 487 bp, Artificial
  TaSBEIIa allele with mutations introduced by TALEN pair TaSBEIIa_T03
gagagatagctggattaggcgatcgcgcttcctgaacctgttattttttccccgcggggaaatgcgttagtgtcacccaggccccggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcgttgggccactgaa

SEQ ID NO: 9440 - DNA, 486 bp, Artificial; identical to SEQ ID NO: 8779
  TaSBEIIa allele with mutations introduced by TALEN pair TaSBEIIa_T03

SEQ ID NO: 9441 - DNA, 487 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagtccttggccccgtgctggctcttgggccactgaa

SEQ ID NO: 9442 - DNA, 499 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggcagtgagcgcaacgcaattaatgtgagttagctcactcattaggcaccccagggaagtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgtt

SEQ ID NO: 9443 - DNA, 484 bp, Artificial; identical to SEQ ID NO: 8867
  TaSBEIIa allele with mutations introduced by TALEN pair TaSBEIIa_T03

SEQ ID NO: 9444 - DNA, 471 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 9445 - DNA, 485 bp, Artificial; identical to SEQ ID NO: 8862
  TaSBEIIa allele with mutations introduced by TALEN pair TaSBEIIa_T03

SEQ ID NO: 9446 - DNA, 448 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcgacttggcaagtccggcgcaacctgaagaattacaggtacacacactcgtgccggtaaatcttcatacaatcgttattcacttaccaaatgccggatgaaaccaccacggatgcgtcaggtttcgagcttctctatcagcattgtgcagtactgcactgccttgttcattttgttagccttggccccgtgctggctcttgggccactgaa

SEQ ID NO: 9447 - DNA, 485 bp, Artificial; identical to SEQ ID NO: 9149
  TaSBEIIa allele with mutations introduced by TALEN pair TaSBEIIa_T03

SEQ ID NO: 9448 - DNA, 443 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcgttgggccactgaa

SEQ ID NO: 9449 - DNA, 484 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctcaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagccttggccccgtgctggctcttgggccactgaa

SEQ ID NO: 9450 - DNA, 523 bp, Artificial
  TaSBEIIa allele with mutations introduced by TALEN pair TaSBEIIa_T03
  misc_feature (409); (439); (493): n is a or c or t or g
gagagatagctggattaggcgatcgcgcttcctgaacctgttattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaagattctccaaaaaaatcttcatggtaaccgtccctctcgaaggatgtttttcagtatccggctaaaaagggaaaggtcctggtgcctgacggcgagagcgacgacttggcaagtccggcgcaacctgaagaattacaggtacacacactcgtgccggtaaancttcatacaatcgttatcacttaccaaatnccggatgaaaccaacacggatgcgtcaggtttcgagcttctctatcagcattgngcagtactgcactgccttgttcatttttcg

SEQ ID NO: 9451 - DNA, 486 bp, Artificial; identical to SEQ ID NO: 8779
  TaSBEIIa allele with mutations introduced by TALEN pair TaSBEIIa_T03

SEQ ID NO: 9452 - DNA, 488 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggaatgaaaaccaaccacggatgcgtcaggtttcgagcttcttctatcagcattgtgcagtactgcactgccttgttcattttgttagccttggccccgtgctggctcttgggccactgaa

SEQ ID NO: 9453 - DNA, 485 bp, Artificial; identical to SEQ ID NO: 8782
  TaSBEIIa allele with mutations introduced by TALEN pair TaSBEIIa_T03

SEQ ID NO: 9454 - DNA, 485 bp, Artificial
  TaSBEIIa allele with mutations introduced by TALEN pair TaSBEIIa_T03
gagagatagctggattaggcgatcgcgcttcctgacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaacgaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 9455 - DNA, 485 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagaggtcctggtgcctgacggcgagagcgacgacttggcaagtccggcgcaaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgcctgttcatttgttagccttggccccgtgctggctcttgggccactgaa

SEQ ID NO: 9456 - DNA, 484 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttatcacttaccaaatgccggatgaaaccaaccacggatgcgtcaggtttcgagcttcttctatcagcattgtgcagtactgcactgccttgttcattttgttagtccttggccccgtgctggctcttgggccactga

SEQ ID NO: 9457 - DNA, 486 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaaccaaccacggatgcgtcaggtttcgagcttcttctatcagcattgtgcagtactgcactgccttgttcattttgtagccttggccccgtgctggctcttgggccactgaa

SEQ ID NO: 9458 - DNA, 516 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaagattctccaaaaaaatcttcatggtaaccgtccctctcgaaggatgttttcagtatccggctaaaagggaaaggtcctggtgcctgacggcgagagcgacgacttggcaagtccggcgcaacctgaagaattacaggtacacacactcgtgcccggtaaatcttcatacaatcgttattcacttaccaaatgccggatgaaaccaacacggatgcgtcaggtttcgagcttcttctatcagcattgtgcagtactgcactgccttgttca

SEQ ID NO: 9459 - DNA, 501 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggcagtgagcgcaacgcaattaatgtgagttagctcactcattaggcaccccagggaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttt

SEQ ID NO: 9460 - DNA, 482 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcaaggtcctggtgcctgacggcgagagcgacgacttggcaagtccggcgcaacctgaagaattacaggtacacacactcgtgccggtaaatcttcatacaatcgttatcacttaccaaatgccggatgaaaccaccacggatgcgtcaggtttcgagcttcttctatcagcattgtgcagtactgcactgccttgttcattttgtagccttggccccgtgctggctcttgggccactgaa

SEQ ID NO: 9461 - DNA, 436 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctcgtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgttagccgtggccccgtgctggctctggccactga

SEQ ID NO: 9462 - DNA, 489 bp, Artificial
  TaSBEIIa allele with mutations introduced by TALEN pair TaSBEIIa_T03
gagagatagctggattaggcgatcgcgcttcctgaacctgtattttttccccgtcggggaaatgcgttagtgtcacccaggcccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagtccttggccccgtgctggctcttgggccactgaa

SEQ ID NO: 9463 - DNA, 488 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgtcgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaaccaccacggatgcgtcaggtttcgagcttcttctatcagcattgtgcagtactgcactgccttgttcattttgttagccttggccccgtgctggctcttggggccactggaa

SEQ ID NO: 9464 - DNA, 506 bp, Artificial
  TaSBEIIa allele with mutations introduced by TALEN pair TaSBEIIa_T03
gagagatagctggattaggcgatcgcgcttcctgaacctgtattttttcccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcaacgtcaaatttcccatacagagctaagggataatgcgtagcgttcacgtaactggaaggtcctggtgcctgacggcgagagcgacgacttggcaagtccggcgcaaacctgaaagaattacaggtacacacactcgtgcccggtaaatcttcatacaatcgttattcacttaccaaatgccggatgaaaccaaccacggatgcgtcaggtttcgagcttctctatcagcattgtgcagtactgcactgccttgttcattttgt

SEQ ID NO: 9465 - DNA, 486 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttatcacttaccaaatgccggatgaaaccaaccacggatgcgtcaggtttcgagcttcttctatcagcattgtgcagtactgcactgccttgttctattttgtagccttgggccccgtgctggctcttgggccactgaa

SEQ ID NO: 9466 - DNA, 488 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagccttcggccccgtgctggctcttgggccactgaa

SEQ ID NO: 9467 - DNA, 482 bp, Artificial
  TaSBEIIa allele with mutations introduced by TALEN pair TaSBEIIa_T03
  misc_feature (449): n is a or c or t or g
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgtattcacttaccaaatgccggatgaaaccaaccacggatgcgtcaggtttcgagcttctctatcagcattgtgcagtactgcactgccttgttcattttgtanccttggccccgtgctggctcttgggccactgaa

SEQ ID NO: 9468 - DNA, 508 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagcgcacgagggagcttccagggggaaacgcctggaaggtcctggtgcctgacggcgagagcgacgacttggcaagtccggcgcaacctgaagattacaggtacacaccatcgtgccgggaaatcttcatacaatcgttattcacttaccaaatgccggatgaaaccagccgcggaggcgtcaggttttgagcttcttctatcagcattgtgcagtactgcactgccttgtgctattttgtagccgtgccccgtgctggcttcg

SEQ ID NO: 9469 - DNA, 485 bp, Artificial; identical to SEQ ID NO: 8782
  TaSBEIIa allele with mutations introduced by TALEN pair TaSBEIIa_T03

SEQ ID NO: 9470 - DNA, 487 bp, Artificial; identical to SEQ ID NO: 8822
  TaSBEIIa allele with mutations introduced by TALEN pair TaSBEIIa_T03

SEQ ID NO: 9471 - DNA, 474 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttctattttgtagccttggccccgtgctggctcgttgggccactgaa

SEQ ID NO: 9472 - DNA, 493 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagtccttcggccccgtgctggtctcttcgggccactcgaa

SEQ ID NO: 9473 - DNA, 484 bp, Artificial; identical to SEQ ID NO: 8791
  TaSBEIIa allele with mutations introduced by TALEN pair TaSBEIIa_T03

SEQ ID NO: 9474 - DNA, 486 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagtcctggtgcctgacggcgagagcgacgacttggcaagtccggcgcaacctgaagaattacaggtacacacactcgtgccggtaaatcttcatacaatcgttattcacttaccaaatgccggatgaaaaccaaccacggatgcgtcaggtttcgagcttcttctatcagcattgtgcagtactgcactgccttgttctattttgttagccttggccccgtgctggctcttgggccactgaa

SEQ ID NO: 9475 - DNA, 483 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctttggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagcctttggccccgtgctggctcttgggccactgaa

SEQ ID NO: 9476 - DNA, 485 bp, Artificial; identical to SEQ ID NO: 8782
  TaSBEIIa allele with mutations introduced by TALEN pair TaSBEIIa_T03

SEQ ID NO: 9477 - DNA, 484 bp, Artificial; identical to SEQ ID NO: 9004
  TaSBEIIa allele with mutations introduced by TALEN pair TaSBEIIa_T03

SEQ ID NO: 9478 - DNA, 471 bp, Artificial; identical to SEQ ID NO: 9391
  TaSBEIIa allele with mutations introduced by TALEN pair TaSBEIIa_T03

SEQ ID NO: 9479 - DNA, 485 bp, Artificial; identical to SEQ ID NO: 8782
  TaSBEIIa allele with mutations introduced by TALEN pair TaSBEIIa_T03

SEQ ID NO: 9480 - DNA, 487 bp, Artificial; identical to SEQ ID NO: 8912
  TaSBEIIa allele with mutations introduced by TALEN pair TaSBEIIa_T03

SEQ ID NO: 9481 - DNA, 469 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggtgcctgacggcgagagcgacgacttggcaagtccggcgcaacctgaagattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagtccttggccccgtgctggctcttgggccactgaa

SEQ ID NO: 9482 - DNA, 484 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactacaagttgtggcgttttttcactattgtagtcatccttgcattttgcaggcgccgtcctgagccgcgcggcctctcaaggtcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 9483 - DNA, 486 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacaacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 9484 - DNA, 444 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaaggtcctggtgcctgacggtgagagcgacgacttggcaagtccggcgcaacctgaagattacaggtacacaccatcgtgccgggaaatcttcatacaatcgtattcacttaccaaatgccggatgaaaccaagccgcggaggcgtcaggtttgagcttcttctatcagcattgtgcagtactgcactgccttgtgctattttgttagccgttggccccgtgctgggctcgttgggcctactgaa

SEQ ID NO: 9485 - DNA, 517 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcccggccacgggtttacacacgcgcacatcgttgcgttaagccaacacccggcagaaaaaaaggatctcaagaagatcctttgatcttttctacggggtctgacgctcagtggaacgaaaactcacgttaagggattttggtcatgagatgcctgacggcgagagcgacgacttggcaagtccggcgcaacctgaagaattacaggtacacacactcgtgccggtaaatctcatacaatcgtatcactacaatgcgatgaaccacacgatgcgtc

SEQ ID NO: 9486 - DNA, 487 bp, Artificial; identical to SEQ ID NO: 8912
  TaSBEIIa allele with mutations introduced by TALEN pair TaSBEIIa_T03

SEQ ID NO: 9487 - DNA, 487 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgtagccttggccccgtgctgggctcttgggccactgaa

SEQ ID NO: 9488 - DNA, 486 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaaccaccacggatgcgtcaggtttcgagcttcttctatcagcattgtgcagtactgcactgccttgttcattttgttagccttggccccgtgctggctcttgggccactgaa

SEQ ID NO: 9489 - DNA, 485 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaccacgatgcgtcaggttcgagcttcttctatcagcattgtgcagtactgcactgccttgttctattttgttagtccttggccccgtgctggctcttcgggccactgaa

SEQ ID NO: 9490 - DNA, 488 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtcgcctgacggcgagagcgacgacttggcaagtccggcgcaaacctgaagaattacaggtacacacactcgtgccggtaaatcttcatacaatcgttattcacttaccaaatgccggatgaaaaccaaccacggatgcgtcaggtttcgagcttcttctatcagcattgtgcagtactgcactgccttgttcattttgttagccttggccccgtgctggctcttgggccactgaa

SEQ ID NO: 9491 - DNA, 482 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcatttttgcaggcgccgtcctgagccgcgcggcctctaggtcctggtgcctgacggcgagagcgacgacttggcaagtccggcgcaacctgaagattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 9492 - DNA, 485 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccgcggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 9493 - DNA, 456 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctcttcgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 9494 - DNA, 480 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctcttcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 9495 - DNA, 483 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttatcacttaccaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 9496 - DNA, 483 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgtagccttggccccgtgctggctcttgggccactgaa

SEQ ID NO: 9497 - DNA, 486 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 9498 - DNA, 486 bp, Artificial
  TaSBEIIa allele with mutations introduced by TALEN pair TaSBEIIa_T03
gagagatagctggattaggctatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 9499 - DNA, 482 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctgtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagccttggccccgtgcctggctcttgggccatgaa

SEQ ID NO: 9500 - DNA, 443 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccacgtgaa

SEQ ID NO: 9501 - DNA, 447 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagaccgcggaggcgtcaggttttgagcttcttctatcagcattgtgcagtactgcactgccttgtgctattttgttagccgtggccccgttgctggctcgttgggccacgtgaa

SEQ ID NO: 9502 - DNA, 487 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagtccgttggccccgtgctggctcttgggccactgaa

SEQ ID NO: 9503 - DNA, 465 bp, Artificial; identical to SEQ ID NO: 8878
  TaSBEIIa allele with mutations introduced by TALEN pair TaSBEIIa_T03

SEQ ID NO: 9504 - DNA, 486 bp, Artificial; identical to SEQ ID NO: 8770
  TaSBEIIa allele with mutations introduced by TALEN pair TaSBEIIa_T03

SEQ ID NO: 9505 - DNA, 486 bp, Artificial; identical to SEQ ID NO: 8861
  TaSBEIIa allele with mutations introduced by TALEN pair TaSBEIIa_T03

SEQ ID NO: 9506 - DNA, 485 bp, Artificial; identical to SEQ ID NO: 8782
  TaSBEIIa allele with mutations introduced by TALEN pair TaSBEIIa_T03

SEQ ID NO: 9507 - DNA, 473 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagtccttcggccccgtgctggctcttgggccactgaa

SEQ ID NO: 9508 - DNA, 506 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcaacgtcaaatttcccatacagagctaagggataatgcgtagcgttcacgtaactggaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgtt

SEQ ID NO: 9509 - DNA, 479 bp, Artificial; identical to SEQ ID NO: 8885
  TaSBEIIa allele with mutations introduced by TALEN pair TaSBEIIa_T03

SEQ ID NO: 9510 - DNA, 485 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctatttgtagtccttggccccgtgctggctcttgggccactgaa

SEQ ID NO: 9511 - DNA, 486 bp, Artificial; identical to SEQ ID NO: 8779
  TaSBEIIa allele with mutations introduced by TALEN pair TaSBEIIa_T03

SEQ ID NO: 9512 - DNA, 483 bp, Artificial; identical to SEQ ID NO: 8895
  TaSBEIIa allele with mutations introduced by TALEN pair TaSBEIIa_T03

SEQ ID NO: 9513 - DNA, 485 bp, Artificial; identical to SEQ ID NO: 8782
  TaSBEIIa allele with mutations introduced by TALEN pair TaSBEIIa_T03

SEQ ID NO: 9514 - DNA, 486 bp, Artificial
  TaSBEIIa allele with mutations introduced by TALEN pair TaSBEIIa_T03
gagagatagctggattaggcgatcgcgcttcctgaacctgttattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaacacggatgcgtcaggtttcgagcttcttctatcagcattgtgcagtactgcactgccttgttcattttgttagtccttggccccgtgctggctcttgggccactgaa

SEQ ID NO: 9515 - DNA, 487 bp, Artificial; identical to SEQ ID NO: 9341
  TaSBEIIa allele with mutations introduced by TALEN pair TaSBEIIa_T03

SEQ ID NO: 9516 - DNA, 487 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacgggatgcgtcaggtttcgagcttcttctatcagcattgtgcagtactgcactgccttgttctattttgttagccttggccccgtgctggctcttgggccactgaa

SEQ ID NO: 9517 - DNA, 486 bp, Artificial; identical to SEQ ID NO: 8779
  TaSBEIIa allele with mutations introduced by TALEN pair TaSBEIIa_T03

SEQ ID NO: 9518 - DNA, 511 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaccgtattaccgcctttgagtgagctgataccgctcgccgcagccgaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgtagtccttggtccccg

SEQ ID NO: 9519 - DNA, 486 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatcctttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 9520 - DNA, 485 bp, Artificial; identical to SEQ ID NO: 8782
  TaSBEIIa allele with mutations introduced by TALEN pair TaSBEIIa_T03

SEQ ID NO: 9521 - DNA, 494 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactcgcactgtccttgttctaattttgttagtccgttcggtcccccgtgctggctcttgggccactgaa

SEQ ID NO: 9522 - DNA, 467 bp, Artificial; identical to SEQ ID NO: 9077
  TaSBEIIa allele with mutations introduced by TALEN pair TaSBEIIa_T03

SEQ ID NO: 9523 - DNA, 484 bp, Artificial
  TaSBEIIa allele with mutations introduced by TALEN pair TaSBEIIa_T03
gagagatagctggattaggcgatcgcgcttcctgaacctgtatttttttcccccgcgggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcgtcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 9524 - DNA, 483 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcacttattgtagtcatccttgcattttgcaggcgccgtcctgagccgcgcggcctctcgtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 9525 - DNA, 487 bp, Artificial; identical to SEQ ID NO: 8822
  TaSBEIIa allele with mutations introduced by TALEN pair TaSBEIIa_T03

SEQ ID NO: 9526 - DNA, 473 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccagggccaccacctgctccggggtcaagccgtgggcctggcacagcaccggcaacagccgctggacaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgtt

SEQ ID NO: 9527 - DNA, 483 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaaccaacacggatagcgtcaggtttcgagcttcttctatcagcattgtgcagtactgcactgccttgttcatttgttagccttggccccgtgctgctcttggcactgaa

SEQ ID NO: 9528 - DNA, 481 bp, Artificial; identical to SEQ ID NO: 8835
  TaSBEIIa allele with mutations introduced by TALEN pair TaSBEIIa_T03

SEQ ID NO: 9529 - DNA, 488 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttacatacaatcgttattcacttaccaaatgccggatgaaaccaaccacggatgcgtcaggtttcgagcttcttctatcagcattcgtgcagtactgcactgccttgttcattttgttagccttggccccgtgctggctcttgggccactgaa

SEQ ID NO: 9530 - DNA, 489 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagtccttggccccgtgctggctcttcgggccactgaa

SEQ ID NO: 9531 - DNA, 486 bp, Artificial
  TaSBEIIa allele with mutations introduced by TALEN pair TaSBEIIa_T03
  misc_feature (387): n is a or c or t or g
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcaaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggangcgtcaggtttcgagcttcttctatcagcattgtgcagtactgcactgccttgttcattttgttagccttggccccgtgctggctcttgggccactgaa

SEQ ID NO: 9532 - DNA, 487 bp, Artificial
  TaSBEIIa allele with mutations introduced by TALEN pair TaSBEIIa_T03
gtgagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcgttgggccactgaa

SEQ ID NO: 9533 - DNA, 485 bp, Artificial; identical to SEQ ID NO: 8782
  TaSBEIIa allele with mutations introduced by TALEN pair TaSBEIIa_T03

SEQ ID NO: 9534 - DNA, 468 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 9535 - DNA, 479 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctgtcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcgttgggccactgaa

SEQ ID NO: 9536 - DNA, 486 bp, Artificial; identical to SEQ ID NO: 8887
  TaSBEIIa allele with mutations introduced by TALEN pair TaSBEIIa_T03

SEQ ID NO: 9537 - DNA, 487 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaacccaaccacggatgcgtcaggtttcgagcttcttctatcagcattgtgcagtactgcactgccttgttcattttgttagccttggccccgtgctggctcttgggccactgaa

SEQ ID NO: 9538 - DNA, 440 bp, Artificial
  TaSBEIIa allele with mutations introduced by TALEN pair TaSBEIIa_T03
gagagatagctggattaggcgatcgcctcaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaacccaaccacggatgcgtcaggtttcgagcttcttctatcagcattgtgcagtactgcactgccttgttctattttgttagtccttggccccgtgctggctcttgggccactgaa

SEQ ID NO: 9539 - DNA, 484 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccgtcctggtgccgtgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 9540 - DNA, 504 bp, Artificial
  TaSBEIIa allele with mutations introduced by TALEN pair TaSBEIIa_T03
  misc_feature (491): n is a or c or t or g
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggcccacggcttcgaccccccagcaggtggtggccatcgccagcaataatggtggcaagcaggcgctggaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgngcagtactgctac

SEQ ID NO: 9541 - DNA, 482 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcgtcctggtgcctgacggcgagagcgacgacttggcaagtccggcgcaacctgaagaattacaggtacacacactcgtgccggtaaatcttcatacaatcgttattcacttaccaatgccggatgaaaccaaccacggatgcgtcaggtttcgagcttcttctatcagcattgtgcagtactgcactgccttgttctattttgttagccttggccccgtgctggctcttgggccactgaa

SEQ ID NO: 9542 - DNA, 489 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatcgaaaccaaccacggatgcgtcaggtttcgagcttcttctatcagcattgtgcagtactgcactgccttgttctattttgttagtccttggccccgtgtctggctcttgggccactgaa

SEQ ID NO: 9543 - DNA, 488 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagccttggccccgtgctggctcttgggccactgaa

SEQ ID NO: 9544 - DNA, 522 bp, Artificial
  TaSBEIIa allele with mutations introduced by TALEN pair TaSBEIIa_T03
gacgagatagctggtataggcatcgcgcttcctgaacctgtattttttccccgcgggggaaatgcgttagtgtcacccaggccctggtgttaccacggctttgatcattcctcgtttcattctgatatatattttctcactctttttcttcctgttcttgctggtaactgcaagttgtggcgttttttcactattgtagtcatccttgcattttgcaggcgccgtcctgagccgcgcggcctctccagggagcagacaagcccgtcagggcgcgtcagcgggtgttggcgggtgtcgggggagcccacggtgtagatggcgccgtcgggcttcctggagccgcccaggtgcttgccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcagcttctctta

SEQ ID NO: 9545 - DNA, 437 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctcaggtcctggtgcctgacggtgagagcgacgacttggcaagtccggcgcaacctgaagaattacaggtacacaccatcgtgccgggaaatcttcatacaatcgttattcacttaccaaaatgccggatgaaccaagccgcggaggcgtcaggtttgagcttcttctatcagcattgtgcagtactgcactgccttgtgcattttgtagccgtggcccgtgctggctcttgggccactgaa

SEQ ID NO: 9546 - DNA, 488 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaaccaaccacggatgcgtcaggtttcgagcttcttctatcagcattgtagcagtactgcactgccttgttcattttgttagtccttggccccgtgctggctcttgggccactgaa

SEQ ID NO: 9547 - DNA, 479 bp, Artificial; identical to SEQ ID NO: 9018
  TaSBEIIa allele with mutations introduced by TALEN pair TaSBEIIa_T03

SEQ ID NO: 9548 - DNA, 441 bp, Artificial; identical to SEQ ID NO: 8771
  TaSBEIIa allele with mutations introduced by TALEN pair TaSBEIIa_T03

SEQ ID NO: 9549 - DNA, 505 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagaagatcctttttgataatctcatgaccaaaatcccttaacgtgagttttcgttccactgagcgtcaaggtcctggtgcctgacggcgagagcgacgacttggcaagtccggcgcaacctgaagaattacaggtacacacactcgtgccggtaaatcttcatacatcgttatcacttaccaaatgccggatgaaaccaaccacggatgcgtcaggtttcgagcttctctatcagcattgtgcagtctgcactgccttgtt

SEQ ID NO: 9550 - DNA, 484 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagtccttggccccgtgctggctcttggccactgaa

SEQ ID NO: 9551 - DNA, 480 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgcctggctcttgggccactgaa

SEQ ID NO: 9552 - DNA, 484 bp, Artificial; identical to SEQ ID NO: 9261
  TaSBEIIa allele with mutations introduced by TALEN pair TaSBEIIa_T03

SEQ ID NO: 9553 - DNA, 485 bp, Artificial; identical to SEQ ID NO: 8782
  TaSBEIIa allele with mutations introduced by TALEN pair TaSBEIIa_T03

SEQ ID NO: 9554 - DNA, 484 bp, Artificial; identical to SEQ ID NO: 8867
  TaSBEIIa allele with mutations introduced by TALEN pair TaSBEIIa_T03

SEQ ID NO: 9555 - DNA, 474 bp, Artificial; identical to SEQ ID NO: 9013
  TaSBEIIa allele with mutations introduced by TALEN pair TaSBEIIa_T03

SEQ ID NO: 9556 - DNA, 487 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagtccttggccccgtgctggctctcgggccactgaa

SEQ ID NO: 9557 - DNA, 441 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 9558 - DNA, 484 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttccatcagcattgtgcagtactgcactgccttgttcatttgttagccttggccccgtgctggctcttgggccactgaa

SEQ ID NO: 9559 - DNA, 450 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagcctttggccccgtgctggctcttgggccactgaa

SEQ ID NO: 9560 - DNA, 478 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcgtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagtccttggccccgtgctggctcttgggccactgaa

SEQ ID NO: 9561 - DNA, 484 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactga

SEQ ID NO: 9562 - DNA, 487 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgcctggctcttgggccactgaa

SEQ ID NO: 9563 - DNA, 485 bp, Artificial; identical to SEQ ID NO: 8782
  TaSBEIIa allele with mutations introduced by TALEN pair TaSBEIIa_T03

SEQ ID NO: 9564 - DNA, 487 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtacctgcactgccttgttcattttgttagtccttggccccgtgctggctcttgggccactgaa

SEQ ID NO: 9565 - DNA, 445 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgttgctggctcgttgggccacgtgaa

SEQ ID NO: 9566 - DNA, 490 bp, Artificial
  TaSBEIIa allele with mutations introduced by TALEN pair TaSBEIIa_T03
gagagatagctggattaggcgatcgcgcttcctgaacctgttattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagtccttcggccccgtgctggctcttgggccactgaa

SEQ ID NO: 9567 - DNA, 488 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcaaggtcctggtgcctgacggcgagagcgacgacttggcaagtccggcgcaacctgaacgaattacaggtacacacactcgtgccggtaaatccttcatacaatcgttattcacttaccaaatgccggatgaaaccaaccacggatgcgtcaggtttcgagcttcttctatcagcattgtgcagtactgcactgccttgttcattttgttagccttggtccccgtgctggctcttcgggcactgaa

SEQ ID NO: 9568 - DNA, 488 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagtcttcttctatcagcattgtgcagtactgcactgccttgttctattttgttagtccttggccccgtgctggctcttgggccactgaa

SEQ ID NO: 9569 - DNA, 484 bp, Artificial; identical to SEQ ID NO: 8791
  TaSBEIIa allele with mutations introduced by TALEN pair TaSBEIIa_T03

SEQ ID NO: 9570 - DNA, 487 bp, Artificial; identical to SEQ ID NO: 8822
  TaSBEIIa allele with mutations introduced by TALEN pair TaSBEIIa_T03

SEQ ID NO: 9571 - DNA, 489 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttacatacaatcgttattcacttaccaaatgccggatgaaaccaaccacggatgcgtcaggtttcgagcttcttctatcagccattgtgcagtactgcactgccttgttctatttgttagccttggccccgtgcctggctcttgggccactgaa

SEQ ID NO: 9572 - DNA, 481 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccggtcctggtgcctgacggcgagagcgacgacttggcaagtccggcgcaacctgaagaattacaggtacacacactcgtgccggtaaatcttcatacaatcgttatcacttaccaaatgccggatgaaaccaaccacggatgcgtcaggtttcgagcttcttctatcagcattgtgcagtactgcactgccttgttcattttgtagccttggccccgtgctgctcttgggccactgaa

SEQ ID NO: 9573 - DNA, 470 bp, Artificial; identical to SEQ ID NO: 8841
  TaSBEIIa allele with mutations introduced by TALEN pair TaSBEIIa_T03

SEQ ID NO: 9574 - DNA, 505 bp, Artificial
  TaSBEIIa allele with mutations introduced by TALEN pair TaSBEIIa_T03
  misc_feature (491): n is a or c or t or g
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggcccacggcttgaccccccagcaggtggtggccatcgccagcaataatggtggcaagcaggcgctggaaggtcctggtgcctgacggcgagagcgacgacttggcaagtccggcgcaacctgaagaattacaggtacacacactcgtgcccggtaaatcttcatacaatcgttattcacttaccaaatgccggatgaaaccaaccacggatgcgtcaggtttcgagcttcttctatcagcattgngcagtactgctacg

SEQ ID NO: 9575 - DNA, 510 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggcgatggccaccacctgctccggggtcaagccgtgggaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggt

SEQ ID NO: 9576 - DNA, 492 bp, Artificial
  TaSBEIIa allele with mutations introduced by TALEN pair TaSBEIIa_T03
gagagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcattttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcatttttgttagtccttggcccccggtgcctggctcttgggccactgaa

SEQ ID NO: 9577 - DNA, 505 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagtctccagcgcctgttgccggtgctgtgccaggcccacggcttgaccccggagcaggtggtggaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgcctttg

SEQ ID NO: 9578 - DNA, 486 bp, Artificial; identical to SEQ ID NO: 8779
  TaSBEIIa allele with mutations introduced by TALEN pair TaSBEIIa_T03

SEQ ID NO: 9579 - DNA, 487 bp, Artificial; identical to SEQ ID NO: 8931
  TaSBEIIa allele with mutations introduced by TALEN pair TaSBEIIa_T03

SEQ ID NO: 9580 - DNA, 487 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccgatgaaaccaaccacggatgcgtcaggtttcgagcttcttctatcagcattgtgcagtactgcactgccttgttctattttgttagccttggccccgttgctggctcttgggccactgaa

SEQ ID NO: 9581 - DNA, 472 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagtccttggccccgtgctggctcttgggccactgaa

SEQ ID NO: 9582 - DNA, 483 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggcccaggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcgtcctggtgcctgacggcgagagcgacgacttggcaagtccggcgcaacctgaagaattacaggtacacacactcgtgccggtaaatcttcatacaatcgttattcacttaccaaatgccggatgaaaaccaaccacggatgcgtcaggtttcgagcttcttctatcagcattgtgcagtactgcactgccttgttcattttgttagccttggccccgtgctggctcttgggccactgaa

SEQ ID NO: 9583 - DNA, 489 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtccctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttccgagcttcttctatcagcattgtgcagtactgcactgccttgttcattttgttagccttggccccgtgcctggctttgggcctacgtgaa

SEQ ID NO: 9584 - DNA, 485 bp, Artificial; identical to SEQ ID NO: 8782
  TaSBEIIa allele with mutations introduced by TALEN pair TaSBEIIa_T03

SEQ ID NO: 9585 - DNA, 486 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccgatgaaaccaaccacggatgcgtcaggtttcgagcttcttctatcagcattgtgcagtactgcactgccttgttcattttgttagtccttggccccgtgctggctcttgggcctactgaa

SEQ ID NO: 9586 - DNA, 505 bp, Artificial
  TaSBEIIa allele with mutations introduced by TALEN pair TaSBEIIa_T03
gagagatagctggattaggcgatcgcgcttcctgaacctgtattttttccccgcgggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccatccactgcggtcacgccgccacgtttgcaatctcggacagcacggcgccgttgcagttggtgatgtggttcagcctggtcagctgggccttggtacggtcctggtgcctgacggcgagagcgacgacttggcaagtccggcgcaacctgaacgaattacagggtacacacactcgtgccggtaaatcttcatacaatcgttattcacttaccaatgccggatgaaaccaacacggatgcgtcaggtttcgagcttctct

SEQ ID NO: 9587 - DNA, 485 bp, Artificial; identical to SEQ ID NO: 8782
  TaSBEIIa allele with mutations introduced by TALEN pair TaSBEIIa_T03

SEQ ID NO: 9588 - DNA, 485 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaaccacacggatgcgtcaggtttcgagcttcttctatcagcattgtgcagtactgcactgccttgttcattttgttagccttggccccgtgctggctcttgggccactgaa

SEQ ID NO: 9589 - DNA, 507 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagagtaggccttggtgtccacgatcacgccgacggggagtcaggcaactatggatgaacgaaatagaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgcctttg

SEQ ID NO: 9590 - DNA, 474 bp, Artificial; identical to SEQ ID NO: 9013
  TaSBEIIa allele with mutations introduced by TALEN pair TaSBEIIa_T03

SEQ ID NO: 9591 - DNA, 488 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctgggctctttgggccactgaa

SEQ ID NO: 9592 - DNA, 480 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcctgcctgacggcgagagcgacgacttggcaagtccggcgcaaacctgaaagaattacaggtacacacactcgtgccggtaaatcttcatacaatcgttattcacttaccaaatgccggatgaaaccaaccacggatgcgttcaggtttcgagcttcttctatcagcattgtgcagtactgcactgccttgttcattttgttagccttggccccgtgcctggctcttgggccactgaa

SEQ ID NO: 9593 - DNA, 492 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagtccttggtccccgtgtctggctcgttgggcctactcgaa

SEQ ID NO: 9594 - DNA, 488 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagccttgggccccgtgctggctcgttgggccactgaa

SEQ ID NO: 9595 - DNA, 482 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctcaaggtcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 9596 - DNA, 490 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagtccttggccccgtgctgggctcttgggccacgtgaa

SEQ ID NO: 9597 - DNA, 486 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagtccttggccccgtgctggctcttggccactga

SEQ ID NO: 9598 - DNA, 484 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgtagtccttggccccgtgctggctcttgggccactgaa

SEQ ID NO: 9599 - DNA, 471 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttctctatcagcattgtgcagtactgcactgccttgttcattttgttagtccttggccccgtgctggctcttgggccactgaa

SEQ ID NO: 9600 - DNA, 485 bp, Artificial; identical to SEQ ID NO: 8782
  TaSBEIIa allele with mutations introduced by TALEN pair TaSBEIIa_T03

SEQ ID NO: 9601 - DNA, 487 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggtcctggtgcctgacggcgagagcgacgacttggcaagtccggcgcaacctgaagaattacaggtacacacactcgtgccggtaaatcttcatacaatcgttattcacttaccaaatgccggatcgaaaccaaccacggatgcgtcaggtttcgagcttcttctatcagcattgtgcagtactgcactgccttgttcattttgttagtccttggccccgtgctggctcttgggccactga

SEQ ID NO: 9602 - DNA, 495 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgtctattttgttagtccttcggccccgtgcgtggcttcgttcgggcctacgtcgaa

SEQ ID NO: 9603 - DNA, 492 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgttttcattctgatatatattttctcactctttttcttcctgttcttgctgtaactgcaagttgtggcgttttttcactattgtagtcatccttgcattttgcaggcgccgtcctgagccgcgcggcctctccaaggtcctgggtgcctgacggcgagagcgacgacttgggcaagtccggcgcaacctgaagaattacaggtacacacactcgtgccggtaaatcttcatacaatcgttattcacttaccaaatgccggatgaaaaccaaccacggatgcgtcaggtttcgagcttcttctatcagcattgtgcagtactgcactgccttgttctattttgttagtccttggccccgtgctggctctgggccacgtgaa

SEQ ID NO: 9604 - DNA, 490 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctccaaggtcctggtgcctgacggcgagagcgacgacttggcaagtccggcgcaacctgaagaattacaggtacacacactcgtgccggtaaaatcttcatacaatcgttattcacttaccaaatgccggatgaaaaccaaccacggatgcgtcaggtttcgagcttcttctatcagcattgtgcagtactgcactgccttgttcattttgttagcctttggccccgttgcctgggctcttgggccactgaa

SEQ ID NO: 9605 - DNA, 483 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcaaggtcctggtgcctgacggcgagagcgacgacttggcaagtccggcgcaacctgaagaattacaggtacacacactcgtgccggtaaatcttcatacaatcgtatcacttaccaaatgccggatgaaaccaaccacggatgcgtcaggtttcgagcttcttctatcagcattgtgcagtactgcactgccttgttcattttgtagccttggccccgtgctggctcttagggccactgaa

SEQ ID NO: 9606 - DNA, 504 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctggtaactgcaagttgtggcgttttttcactattgtagtcatccttgcattttgcaggcgccgtcctgagccgcgcggcctctccaggtcacagcttgtctgtaagcggatgccgggagccgcgccctgacgggcttgtctgtctcccgggaaggtcctggtgcctgacggcgagagcgacgacttggcaagtccggcgcaacctgaagattacaggtacacacactcgtgccggtaaatcttcatacaatcgttattcacttaccaaatgccggatgaaaccaccacggatgcgtcaggttcgagcttctctatcagcattgtgcagtactgcactgcctttg

SEQ ID NO: 9607 - DNA, 510 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggggatgtgctgcaaggcgattaagttgggtaacgccagggttttcccagtcacgacgaaggtcctggtgcctgacggcgagagcgacgacttggcaagtccggcgcaacctgaagaattacaggtacacacactcgtgcccggtaaatcttcatacaatcgttattcacttaccaaatgccggatgaaaccaaccacggatgcgtcaggtttcgagcttctctatcagcattgtgcagtactgcactgccttgttcattttgt

SEQ ID NO: 9608 - DNA, 503 bp, Artificial
  TaSBEIIa allele with mutations introduced by TALEN pair TaSBEIIa_T03
  misc_feature (482): n is a or c or t or g
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagaagatcctttttgataatctcatgaccaaaatcccttaacgtgagttttcgttccactgagcgtcaaggtcctggtgcctgacggcgagagcgacgacttggcaagtccggcgcaacctgaagaattacaagtacacacactcgtgccggtaaatcttcatacaatcgttattcacttaccaatgccggatgaaccacacggatgcgtcaggtttcagcttctctatcagcattgngcagtactgcactgccttgtt

SEQ ID NO: 9609 - DNA, 491 bp, Artificial
  TaSBEIIa allele with mutations introduced by TALEN pair TaSBEIIa_T03
gagagatagctggattaggcgatcgcgcttcctgaacctgttattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaaggtcctggtgcctgacggcgagagcgacgacttggcaagtccggcgcaacctgaagaattaccaggtacacacactcgtgccggtaaatcttcatacaatcgtattcacttaccaaatgccggatgaaaaccaaccacggatgcgtcaggtttcgagcttacttctatcagcattgtgcagtactgcactgccttgttcattttgtagtccttggccccgtgcctggctcttgggccactgaa

SEQ ID NO: 9610 - DNA, 442 bp, Artificial; identical to SEQ ID NO: 9246
  TaSBEIIa allele with mutations introduced by TALEN pair TaSBEIIa_T03

SEQ ID NO: 9611 - DNA, 442 bp, Artificial; identical to SEQ ID NO: 9246
  TaSBEIIa allele with mutations introduced by TALEN pair TaSBEIIa_T03

SEQ ID NO: 9612 - DNA, 522 bp, Artificial
  TaSBEIIa allele with mutations introduced by TALEN pair TaSBEIIa_T03
gagagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggagcagacaagcccgtcagggcgcgtcagcgggtgttggcgggtgtcgggggagcccacggtgtagatggcgccgtcgggcttcctggagccgcccaggtgcttgccaaggtcctggtgcctgacggcgagagcgacgacttggcaagtccggcgcaacctgaagattacaggtacacacactcgtgccggtaaatcttcatacaatcgttattcacttaccaaatgccggatgaaaccaaccacggatgcgtcaggtttcgagcttcttctta

SEQ ID NO: 9613 - DNA, 487 bp, Artificial; identical to SEQ ID NO: 8931
  TaSBEIIa allele with mutations introduced by TALEN pair TaSBEIIa_T03

SEQ ID NO: 9614 - DNA, 488 bp, Artificial; identical to SEQ ID NO: 9114
  TaSBEIIa allele with mutations introduced by TALEN pair TaSBEIIa_T03

SEQ ID NO: 9615 - DNA, 481 bp, Artificial; identical to SEQ ID NO: 8784
  TaSBEIIa allele with mutations introduced by TALEN pair TaSBEIIa_T03

SEQ ID NO: 9616 - DNA, 482 bp, Artificial; identical to SEQ ID NO: 9006
  TaSBEIIa allele with mutations introduced by TALEN pair TaSBEIIa_T03

SEQ ID NO: 9617 - DNA, 488 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcaattgtgcagtactgcactgccttgttctattttgttagccttggccccgtgctggctcttgggccactgaa

SEQ ID NO: 9618 - DNA, 486 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgtattcacttaccaaatgccggatgaaaaccaaccacggatgcgtcaggtttcgagcttcttctatcagcattgtgcagtactgcactgccttgttcattttgttagccttggccccgttgctggctcttgggccactgaa

SEQ ID NO: 9619 - DNA, 526 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcccggccacgggtttacacacgcgcacatcgttgcgttaagccaacacccggcaagaaaaaaaggatctcaagaagatcctttgatcttttctacggggtctgacgctcagtggaacgaaaactcacgttaagggattttggtcatgagatgcctgacggcgagagcgacgacttggcaaggtccggcgcaacctgaagaattacaggtacacacactcgtgccggtaaatctcatacaatcgttatcacttaccaaatgccgatgaaaccaacacggatgcgt

SEQ ID NO: 9620 - DNA, 484 bp, Artificial
  TaSBEIIa allele with mutations introduced by TALEN pair TaSBEIIa_T03
gagagatagctggattaggcgatcgcgcttcctgaacctgttattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcaggtcctggtgcctgacggcgagagcgacgacttggcaagtccggcgcaacctgaagattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 9621 - DNA, 474 bp, Artificial; identical to SEQ ID NO: 9013
  TaSBEIIa allele with mutations introduced by TALEN pair TaSBEIIa_T03

SEQ ID NO: 9622 - DNA, 482 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccggtcctggtgcctgacggcgagagcgacgacttggcaagtccggcgcaacctgaagaattacaggtacacacactcgtgccggtaaatcttcatacaatcgttattcacttccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 9623 - DNA, 514 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggatcttaccgctgttgagatccagttcgatgtaacccactcgtgcacccaactgatcttcagcatcttttacttcaccagcgtttctggtgagcaaaaacaggaaggcaaaatgaccgcaggtcctggtgcctgacggcgagagcgacgacttggcaagtccggcgcaacctgaagaattacaggtacacacactcgtgccggtaaatcttcatacaatcgttattcacttaccaaatgaccgatgaaaccaccacggatgcgttacg

SEQ ID NO: 9624 - DNA, 486 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccggtcctggtgcctgacggcgagagcgacgacttggcaagtccggcgcaacctgaagaattacaggtacacacactcgtgccggtaaatcttcatacaatcgttattcacttaccaaatgccggatgaaaacccaaccacggatgcgtcaggtttcgagcttcttctatcagcattgtgcagtactgcactgccttgttcattttgttagccttggccccgtgctggctcttgggccactgaa

SEQ ID NO: 9625 - DNA, 489 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggattgaaaccaaccacggatgcgtcaggtttcgaggcttcttctatcagcattgtgcagtactgcactgccttgttcattttgttagccttggccccgtgcctggctcttgggccactgaa

SEQ ID NO: 9626 - DNA, 483 bp, Artificial; identical to SEQ ID NO: 8895
  TaSBEIIa allele with mutations introduced by TALEN pair TaSBEIIa_T03

SEQ ID NO: 9627 - DNA, 487 bp, Artificial
  TaSBEIIa allele with mutations introduced by TALEN pair TaSBEIIa_T03
gagagatagctggattaggcgatcgcgcttcctgaacctgttattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 9628 - DNA, 471 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccacgtgaa

SEQ ID NO: 9629 - DNA, 510 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggggtcataacgtgactcccttaattctccgctcatgatcattggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagtcttcttctatcagcattgtgcagtactgcactgccttgttctattttgtagtccttggccccgtt

SEQ ID NO: 9630 - DNA, 488 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgtcagtactagtcactgccttgttcattttgttagccttggccccgtgctggctcttgggccactgaa

SEQ ID NO: 9631 - DNA, 442 bp, Artificial; identical to SEQ ID NO: 9246
  TaSBEIIa allele with mutations introduced by TALEN pair TaSBEIIa_T03

SEQ ID NO: 9632 - DNA, 485 bp, Artificial; identical to SEQ ID NO: 8782
  TaSBEIIa allele with mutations introduced by TALEN pair TaSBEIIa_T03

SEQ ID NO: 9633 - DNA, 487 bp, Artificial; identical to SEQ ID NO: 9085
  TaSBEIIa allele with mutations introduced by TALEN pair TaSBEIIa_T03

SEQ ID NO: 9634 - DNA, 483 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggcactgaa

SEQ ID NO: 9635 - DNA, 485 bp, Artificial; identical to SEQ ID NO: 8782
  TaSBEIIa allele with mutations introduced by TALEN pair TaSBEIIa_T03

SEQ ID NO: 9636 - DNA, 510 bp, Artificial; identical to SEQ ID NO: 8858
  TaSBEIIa allele with mutations introduced by TALEN pair TaSBEIIa_T03

SEQ ID NO: 9637 - DNA, 515 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggatcttaccgctgttgagatccagttcgatgtaacccactcgtgcacccaactgatcttcagcatcttttactttcaccagcgtttctgggtgagcaaaaaacaggaaggcaaaatgccgcaggtcctggtgcctgacggcgagagcgacgacttggcaagtccggcgcaacctgaagaattacaggtacacacactcgtgccggtaaatcttcatacaatcgttattcacttaccaaatgccggatgaaaccaacacggatgcgttcg

SEQ ID NO: 9638 - DNA, 484 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctgtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagtccttggccccgtgctggctcgttgggccactgaa

SEQ ID NO: 9639 - DNA, 493 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaggcggcgagatgatcaaggccggcaccctgaccctggaggaggtgaggaggaagttcaacaacggcgagatcaacttcgcggccgactgataactcgagaagggcgcgatcgttcaaacatttggcaatgaaggtcctggtgcctgacggtgagagcgacgacttggcaagtccggcgcaacctgaagaattacaggtacacaccatcgtgccgggaaatcttcatacaatcgttattcacttaccaaatgaccggatagaaaccaagccgcggaggcgtctaggttttgacg

SEQ ID NO: 9640 - DNA, 479 bp, Artificial
  TaSBEIIa allele with mutations introduced by TALEN pair TaSBEIIa_T03
gagagatagctggattaggcgatcgcgcttcctgaacctgtattttttcccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 9641 - DNA, 488 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaaacctgaagaattacaggtacacacactcgtgccggtaaatcttcatacaatcgtattcaacttaccaaatgccggatgaaaaccaaccacggatgcgtcaggtttcgagcttcttctatcagcattgtgcagtactgcactgccttgttcattttgttagccttggccccgtgctggctcttgggccactgaa

SEQ ID NO: 9642 - DNA, 450 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcgacttggcaagtccggcgcaacctgaagaattacaggtacacacactcgtagccggtaaatcttcatacaatcgttattcacttaccaaatgccggatgaaaccaaccacggatgcgtcaggtttcagcttcttctatcagcattgtgcagtactgcactgccttgttcattttgttagccttggccccgtgctggctcttgggccactgaa

SEQ ID NO: 9643 - DNA, 488 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattaccaggtacacacactcgtgccggtaaatcttcatacaatcgttattcacttaccaaatgccggatgaaaaccaaccacggatgcgtcaggtttcgagcttcttctatcagcattgtgcagtactgcactgccttgttcattttgttagccttggccccgtgctggctcttgggccactgaa

SEQ ID NO: 9644 - DNA, 487 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacgcgagagcgacgacttggcaagtccggcgcaacctgaagaattacaggtacacacactcgtgccggtaaatcttcatacaatcgttattcacttaccaaatgccggatgaaaaccaaccacggatgcgtcaggtttcgagcttcttctatcagcattgtgcagtactgcactcgccttgttcattttgttagccttggccccgtgctggctcttgggccactgaa

SEQ ID NO: 9645 - DNA, 486 bp, Artificial; identical to SEQ ID NO: 8948
  TaSBEIIa allele with mutations introduced by TALEN pair TaSBEIIa_T03

SEQ ID NO: 9646 - DNA, 509 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcgaacgaaccttcggtttgatcttctcctgttgctgctggctgtagccgatcgataaggagaccgccgctgccaagttcgagagacagcacatggacaaggtcctggtgcctgacggcgagagcgacgacttggcaagtccggcgcaacctgaagaattacaggtacacacactcgtgccggtaaatcttcatacaatcgttattcacttaccaatgccgatgaaaccaaccacggatgcgtcaggtttcgagtcttcttt

SEQ ID NO: 9647 - DNA, 486 bp, Artificial; identical to SEQ ID NO: 8799
  TaSBEIIa allele with mutations introduced by TALEN pair TaSBEIIa_T03

SEQ ID NO: 9648 - DNA, 488 bp, Artificial; identical to SEQ ID NO: 9543
  TaSBEIIa allele with mutations introduced by TALEN pair TaSBEIIa_T03

SEQ ID NO: 9649 - DNA, 488 bp, Artificial; identical to SEQ ID NO: 9093
  TaSBEIIa allele with mutations introduced by TALEN pair TaSBEIIa_T03

SEQ ID NO: 9650 - DNA, 472 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctcgaatggcgaatggcgcctgatgcggtattttctccttacgcatctgtgcggaaggtcctggtgcctgacggtgagagcgacgacttggcaaggtccggcgcaacctgaagaattacaggtacacaccatcgtgccgggaaatcttcatacaatcgttatcacttaccaaatgccggatgaaaccaaagccgcggaggcgtcaggttttgagcttcttctatcagcattgtgcagtactgcactgccttgtgcattttgttagccgtggccccgt

SEQ ID NO: 9651 - DNA, 482 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagctcttctatcagcattgtgcagtactgcactgccttgttcatttgttagccttggccccgtgctggctcttggcgactgaa

SEQ ID NO: 9652 - DNA, 483 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctttggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcgttgggccactgaa

SEQ ID NO: 9653 - DNA, 486 bp, Artificial; identical to SEQ ID NO: 8861
  TaSBEIIa allele with mutations introduced by TALEN pair TaSBEIIa_T03

SEQ ID NO: 9654 - DNA, 486 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcaaggtcctggtgcctgacggcgagagcgacgacttggcaagtccggcgcaacctgaagaattacaggtacacacactcgtgccggtaaatcttcatacaatcgttattcacttaccaaatgccggatgaaaaccaaccacggatgcgtcaggtttcgagcttcttctatcagcattgtgcagtactgcactgccttgttctattttgtagccttggccccgtgctggctcttgggccactgaa

SEQ ID NO: 9655 - DNA, 476 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggccctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggcccccgtgcctggctcttgggccactgaa

SEQ ID NO: 9656 - DNA, 482 bp, Artificial
  TaSBEIIa allele with mutations introduced by TALEN pair TaSBEIIa_T03
  misc_feature (450): n is a or c or t or g
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaggcggcgagatgatcaaggccggcaccctgaccctggaggaggtgaggaggaagttcaacaacggcgagatcaacttcgcggccgactgataactcgagaagggcgcgatcgttcaaacatttggcaatgaaggtcctggtgcctgacggtgagagcgacgacttggcaagtccggcgcaacctgaagaattacaggtacacaccatcgtgccgggaaatcttcatacaatcgttattcacttaccaatncggatgaacagccgcgagcgtcaggtttgacg

SEQ ID NO: 9657 - DNA, 488 bp, Artificial
  TaSBEIIa allele with mutations introduced by TALEN pair TaSBEIIa_T03
gagagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaggtcacagcttgtctgtaagcggatgccgggagccgcgccctgacgggcttgtctgctcccgggaaggtcctggtgcctgacggcgagagcgacgacttggcaagtccggcgcaacctgaacgaattacaggtacacacactcgtgccggtaaatcttcatacaatcgttattcacttaccaaatgccggatcgaaaccaaccacggatgcgtcaggtttcgagcttcttctatcagcattgtgcagtactgcactgccttgttctatttttg

SEQ ID NO: 9658 - DNA, 489 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccgtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagtccttcggccccgtgctggtctcgttgggccacgtgaa

SEQ ID NO: 9659 - DNA, 482 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagattacaggtacacacactcgtgccggtaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccacgaa

SEQ ID NO: 9660 - DNA, 484 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgtagccttggccccgtgctggctcttgggccactgaa

SEQ ID NO: 9661 - DNA, 487 bp, Artificial; identical to SEQ ID NO: 8912
  TaSBEIIa allele with mutations introduced by TALEN pair TaSBEIIa_T03

SEQ ID NO: 9662 - DNA, 479 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctcttcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 9663 - DNA, 510 bp, Artificial
  TaSBEIIa allele with mutations introduced by TALEN pair TaSBEIIa_T03
  misc_feature (491): n is a or c or t or g
gagagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggagaagatcaaaccgaaggttcgttcgacagtggcgcagcaccacgaggcactggtcggccacgggaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgngcagtactgcactgccttt

SEQ ID NO: 9664 - DNA, 472 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcgttgggccactgaa

SEQ ID NO: 9665 - DNA, 489 bp, Artificial
  TaSBEIIa allele with mutations introduced by TALEN pair TaSBEIIa_T03
gagagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcatttttgttagccttcggccccgtgctggctcttgggccactgaa

SEQ ID NO: 9666 - DNA, 485 bp, Artificial; identical to SEQ ID NO: 9248
  TaSBEIIa allele with mutations introduced by TALEN pair TaSBEIIa_T03

SEQ ID NO: 9667 - DNA, 510 bp, Artificial
  TaSBEIIa allele with mutations introduced by TALEN pair TaSBEIIa_T03
  misc_feature (481): n is a or c or t or g
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggggatgtgctgcaaggcgattaagttgggtaacgccagggttttcccagtcacgacgaaggtcctggtgcctgacggcgagagcgacgacttggcaagtccggcgcaacctgaagaattacaggtacacacactcgtgcccggtaaatcttcatacaatcgttatcacttaccaaatgccggatgaaaccaaccacggatgcgtcaggtttcgagcttcttctatcagcattgngcagtactgcactgccttgttcattttgt

SEQ ID NO: 9668 - DNA, 487 bp, Artificial; identical to SEQ ID NO: 8822
  TaSBEIIa allele with mutations introduced by TALEN pair TaSBEIIa_T03

SEQ ID NO: 9669 - DNA, 479 bp, Artificial; identical to SEQ ID NO: 9662
  TaSBEIIa allele with mutations introduced by TALEN pair TaSBEIIa_T03

SEQ ID NO: 9670 - DNA, 483 bp, Artificial; identical to SEQ ID NO: 8810
  TaSBEIIa allele with mutations introduced by TALEN pair TaSBEIIa_T03

SEQ ID NO: 9671 - DNA, 486 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccggtcctggtgcctgacggcgagagcgacgacttggcaagtccggcgcaacctgaagaattacaggtacacacactcgtgccggtaaatcttcatacaatcgttattcacttaccaaatgccggatgaaacccaaccacggatgcgtcaggtttcgagcttcttctatcagcattgtgcagtactgcactgccttgttcattttgttagccttggccccgtgctggctcttcgggccactgaa

SEQ ID NO: 9672 - DNA, 442 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggtttgagcttcttctatcagcattgtgcagtactgcactgccttgtgctattttgtagccgtggccccgtgctggctcgttgggccactgaa

SEQ ID NO: 9673 - DNA, 485 bp, Artificial; identical to SEQ ID NO: 8909
  TaSBEIIa allele with mutations introduced by TALEN pair TaSBEIIa_T03

SEQ ID NO: 9674 - DNA, 504 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagagaaaataccgcatcaggcgccattcgccattcaggctgcgcaactgttgggaagggcgatcggtgcgggaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagtcttcttctatcagcattgtgcagtactgg

SEQ ID NO: 9675 - DNA, 494 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagagtaggccttggtgtccacgatcacgccgacggggagtcaggcaactatggatgaacgaaatagaaggtcctggtgcctgacggcgagagcgacgacttggcaagtccggcgcaacctgaagaattacaggtacacacactcgtgccggtaaatcttcatacaatcgtattcacttacaaatgccggatgaaaccacacggatgcgtcaggttcagcttctctatcagcattgtgcagtactgcactg

SEQ ID NO: 9676 - DNA, 471 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagtccttggccccgtgctggctcttgggccactgaa

SEQ ID NO: 9677 - DNA, 463 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctgacggcgagagcgacgacttggcaagtccggcgcaacctgaagaattacaggtacacacactcgtgccggtaaatcttcatacaatcgttattcacttaccaaatgccggagtgaaaccaaccacggatgcgtcaggtttcagcttctctatcagcattgtgcagtactgcactgccttgtcatttgtagccttggccccgtgctggctcttgggccactgaa

SEQ ID NO: 9678 - DNA, 489 bp, Artificial
  TaSBEIIa allele with mutations introduced by TALEN pair TaSBEIIa_T03
gagagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagtccttggccccgtgctggctcgttgggccactgaa

SEQ ID NO: 9679 - DNA, 500 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggtcgttttttcactattgtagtcatccttgcattttgcaggcgccgtcctgagccgcgcggcctctccagggcagtgagcgcaacgcaattaatgtgagttagctcactcattaggcaccccagggaaggtcctggtgcctgacggcgagagcgacgacttggcaagtccggcgcaacctgaagaattacaggtacacacactcgtgccggtaaatcttcatacaatcgttattcacttaccaaatgccggatgaaccaacacggatgcgtcaggtttcgagcttctctatcagcattgtgcagtactgcactgcccttgttt

SEQ ID NO: 9680 - DNA, 488 bp, Artificial
  TaSBEIIa allele with mutations introduced by TALEN pair TaSBEIIa_T03
gagagatagctggattaggcgatcgcgcttcctgaacctgttattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgccctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 9681 - DNA, 474 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcgtcctggtgcctgacggcgagagcgacgacttggcaagtccggcgcaacctgaagaattacaggtacacacactcgtgccggtaaatcttcatacaatcgttattcacttaccaaatgccggatgaaaccaacacggatgcgtcaggtttcgagcttcttctatcagcattgtgcagtactgcactgccttgttcattttgttagtccttggccccgtgctggctcttgggccactgaa

SEQ ID NO: 9682 - DNA, 483 bp, Artificial
  TaSBEIIa allele with mutations introduced by TALEN pair TaSBEIIa_T03
gagagatagctggattaggcgatcgcgcttcctgaacctgtattttttcccccgcggggaaatgcgttagtgtcacccaggcccaggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcgtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 9683 - DNA, 510 bp, Artificial
  TaSBEIIa allele with mutations introduced by TALEN pair TaSBEIIa_T03
  misc_feature (489): n is a or c or t or g
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagaagatcctttttgataatctcatgaccaaaatcccttaacgtgagttttcgttccactgagcgtcaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtncagtactgcactgtccttgtt

SEQ ID NO: 9684 - DNA, 486 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctgggctcgttgggccactgaa

SEQ ID NO: 9685 - DNA, 485 bp, Artificial; identical to SEQ ID NO: 8782
  TaSBEIIa allele with mutations introduced by TALEN pair TaSBEIIa_T03

SEQ ID NO: 9686 - DNA, 488 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaaatcttcatacaatcgttatcaacttaccaaatgccggatgaaaccaaccacggatgcgtcaggtttcgagcttcttctatcagcaattgtgcagtactgcactgccttgttctattttgtagtccttggccccgtgctggctcttgggccactgaa

SEQ ID NO: 9687 - DNA, 489 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagtcttcttctatcagcattgtgcagtactgcactgccttgttcattttgttagccttggcccccgtgcctgggctcttgggccactgaa

SEQ ID NO: 9688 - DNA, 489 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccgagttgaggcacaagctgaagtacgtgccccacgagtacatcgagctgatcgagatcgcccggaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttctctatcagcattgtgcagta

SEQ ID NO: 9689 - DNA, 488 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgttttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattaccaggtacacacactcgtgccggtaaatcttcatacaatcgttattcacttaccaaatgccggatgaaaccaaccacggatgcgtcaggtttcgagcttcttctatcagcattgtgcagtactggcactgccttgttcattttgttagccttggccccgtgctggctcttgggccactgaa

SEQ ID NO: 9690 - DNA, 487 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagccttggccccgtgctggctcgttgggccactgaa

SEQ ID NO: 9691 - DNA, 522 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcccggccacgggtttacacacgcgcacatcgttgcgttaagccaacacccggcagaaaaaaaggatctcaagaagatcctttgatcttttcacggggtctgacgctcagtggaacgaaaactcacgttaagggattttggtcatgagatgcctgacggcgagagcgacgacttggcaagtccggcgcaacctgaagaattacaggtacacacactcgtgccggtaaatcttcatacaatcgtattcacttaccaaatgccggatgaaaccaacacggatg

SEQ ID NO: 9692 - DNA, 491 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccgagttgaggcacaagctgaagtacgtgccccacgagtacatcgagctgatcgagatcgcccggaaggtcctggtgcctgacggcgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagta

SEQ ID NO: 9693 - DNA, 488 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaaccaaccacggatgcgtcaggtttcgagcttcttctatcagcattgtgcagtactgcactgccttgttcattttgttagccttggccccgtgctggctcttgggccactcgaa

SEQ ID NO: 9694 - DNA, 487 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctctggtcctggtgcctgacggcgagagcgacgacttggcaagtccggcgcaacctgaagaattacaggtacacaccatcgtgccgggaaatcttcatacaaatcgttattcacttaccaaatgccggatgaaaccaagccgcggaggcgtcaggttttgagcttcttctatcagcattgtgcagtactgcactgccttgtgcattttgttagccgtggcccccgtgctggctcttgggccactgaa

SEQ ID NO: 9695 - DNA, 486 bp, Artificial; identical to SEQ ID NO: 8779
  TaSBEIIa allele with mutations introduced by TALEN pair TaSBEIIa_T03

SEQ ID NO: 9696 - DNA, 483 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctcaaggtcctggtgcctgacggcgagagcgacgacttggcaagtccggcgcaacctgaagaattacaggtacacacactcgtgccggtaaatcttcatacaatcgttatcacttaccaaatgccggatgaaaccaaccacggatgcgtcaggtttcgagcttcttctatcagcattgtgcagtactgcactgccttgttcattttgttagtccttggccccgtgctggctcttgggccactgaa

SEQ ID NO: 9697 - DNA, 485 bp, Artificial; identical to SEQ ID NO: 8862
  TaSBEIIa allele with mutations introduced by TALEN pair TaSBEIIa_T03

SEQ ID NO: 9698 - DNA, 489 bp, Artificial; identical to SEQ ID NO: 8815
  TaSBEIIa allele with mutations introduced by TALEN pair TaSBEIIa_T03

SEQ ID NO: 9699 - DNA, 488 bp, Artificial; identical to SEQ ID NO: 9466
  TaSBEIIa allele with mutations introduced by TALEN pair TaSBEIIa_T03

SEQ ID NO: 9700 - DNA, 486 bp, Artificial
  TaSBEIIa allele with mutations introduced by TALEN pair TaSBEIIa_T03
gagagatagctggattaggcgatcgcgcttcctgaacctgtattttttccccgtcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactga

SEQ ID NO: 9701 - DNA, 485 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttccattttgttagccttggccccgtgcctggctcttgggccactgaa

SEQ ID NO: 9702 - DNA, 484 bp, Artificial
  TaSBEIIa allele with mutations introduced by TALEN pair TaSBEIIa_T03
gagagatagctggattagggatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaaccaaccacggatgcgtcaggtttcgagcttcttctatcagcattgtgcagtactgcactgccttgttcattttgttagccttggccccgtgctggctcttgggccactga

SEQ ID NO: 9703 - DNA, 482 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcgtcctggtgcctgacggcgagagcgacgacttggcaagtccggcgcaacctgaagaattacaggtacacacactcgtgccggtaaatcttcatacaatcgttattcacttaccaaatgccggatgaaaaccaccacggatgcgtcaggtttcgagcttcttctatcagcattgtgcagtactgcactgccttgttcatttgttagccttggccccgtgctggctcgttgggccactgaa

SEQ ID NO: 9704 - DNA, 442 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgaggcttcttctatcagcattgtgcagtactgcactgccttgtgcattttgttagccgtggccccgtgctggctctgggccactgaa

SEQ ID NO: 9705 - DNA, 506 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaccagcaatattggtggcaagcaggcgctggaaaggtcctggtgcctgacggcgagagcgacgacttggcaagtccggcgcaacctgaagaattacaggtacacacactcgtgcccggtaaatcttcatacaatcgttattcacttaccaaatgccggatgaaaccaaccacggatgcgtcaggtttcgagcttcttctatcagcattgtgcagtactgcactgccttgttcattttgttagtccttggccccgttgctggt

SEQ ID NO: 9706 - DNA, 450 bp, Artificial; identical to SEQ ID NO: 8968
  TaSBEIIa allele with mutations introduced by TALEN pair TaSBEIIa_T03

SEQ ID NO: 9707 - DNA, 487 bp, Artificial; identical to SEQ ID NO: 8822
  TaSBEIIa allele with mutations introduced by TALEN pair TaSBEIIa_T03

SEQ ID NO: 9708 - DNA, 518 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaagattctccaaaaaaatcttcatggtaaccgtccctctcgaaggatgttttcagtatccggctaaaagggaaaggtcctggtgcctgacggcgagagcgacgacttggcaagtccggcgcaacctgaagaattacaggtacacacactcgtgccggtaaatcttcatacaatcgtatcacttaccaaatgccggatgaaaccacacggatgcgtcaggtttcgagcttctctatcagcattgtgcagtactgcactgccttgttcagtttttg

SEQ ID NO: 9709 - DNA, 487 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgcctggctcttgggccactgaa

SEQ ID NO: 9710 - DNA, 484 bp, Artificial; identical to SEQ ID NO: 8845
  TaSBEIIa allele with mutations introduced by TALEN pair TaSBEIIa_T03

SEQ ID NO: 9711 - DNA, 499 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggcgatggccaccacctgctccggggtcaagccgtgggaaggtcctggtgcctgacggcgagagcgacgacttggcaagtccggcgcaacctgaagaattacaggtacacacactcgtgccggtaaaatcttcatacaatcgttattcacttaccaaatgccggatgaaaaccaaccacggatgcgtcaggtttcgagcttctctatcagcattgtgcagtactgcactgccttgttcattttgttagccttgg

SEQ ID NO: 9712 - DNA, 488 bp, Artificial; identical to SEQ ID NO: 9369
  TaSBEIIa allele with mutations introduced by TALEN pair TaSBEIIa_T03

SEQ ID NO: 9713 - DNA, 445 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgttagccgtggccccgtgcctggctcgttgggccactgaa

SEQ ID NO: 9714 - DNA, 442 bp, Artificial; identical to SEQ ID NO: 9246
  TaSBEIIa allele with mutations introduced by TALEN pair TaSBEIIa_T03

SEQ ID NO: 9715 - DNA, 458 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctcttcgacttggcaagtccggcgcaacctgaagaattacaggtacacacactcgtgccggtaaatcttcatacaatcgttattcacttaccaaatgccggatgaaaaccaaccacggatgcgtcaggtttcgagcttcttctatcagcattgtgcagtactgcactgccttgttctattttgttagccttggccccgtgctggctcttgggccactgaa

SEQ ID NO: 9716 - DNA, 487 bp, Artificial
  TaSBEIIa allele with mutations introduced by TALEN pair TaSBEIIa_T03
gagagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcatttttgcaggcgccgtcctgagccgcgcggcctctaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagtccttggccccgtgctggctcttgggccacgtgaa

SEQ ID NO: 9717 - DNA, 487 bp, Artificial
  TaSBEIIa allele with mutations introduced by TALEN pair TaSBEIIa_T03
gagagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagtccttggccccgtgctggctcttgggccactgaa

SEQ ID NO: 9718 - DNA, 491 bp, Artificial
  TaSBEIIa allele with mutations introduced by TALEN pair TaSBEIIa_T03
gagagatagctggtattaggcgaatcgcgcttcctgaacctgtattttttccccgcgggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttatcacttaccaaatgccggatgaaaccaaccacggatgcgtcaggtttcgagcttcttctatcagcattgtgcagtactgcactgccttgttctattttgttagccttgggccccgtgctggctcgttgggccactgaa

SEQ ID NO: 9719 - DNA, 488 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaaccaaccacggatgcgtcaggtttcgagcttcttctatcagcattgtgcagtactgcactgccttgttctattttgttagtccttggccccgtgctggctcttgggccactgaa

SEQ ID NO: 9720 - DNA, 486 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctctgggtcctggtgcctgacggcgagagcgacgacttggcaagtccggcgcaaacctgaagaattacaggtacacacactcgtgccggtaaatcttcatacaatcgtattcacttaccaaatgccggatgaaaccaccacggatgcgtcaggtttcgagcttcttctatcagcattgtggcagtactgcactgccttgttcattttgttagcctttggccccgtgctggctcttgggccactgaa

SEQ ID NO: 9721 - DNA, 502 bp, Artificial
  TaSBEIIa allele with mutations introduced by TALEN pair TaSBEIIa_T03
  misc_feature (493): n is a or c or t or g
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggcagtgagcgcaacgcaattaatgtgagttagctcactcattaggcaccccagggaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactntccttgttt

SEQ ID NO: 9722 - DNA, 487 bp, Artificial; identical to SEQ ID NO: 9085
  TaSBEIIa allele with mutations introduced by TALEN pair TaSBEIIa_T03

SEQ ID NO: 9723 - DNA, 485 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgtattcacttaccaaatgccggatgaaaaccaaccacggatgcgtcaggtttcgagcttcttctatcagcattgtgcagtactgcactgccttgttcattttgtagccttggccccgtgctggctcttgggccactgaa

SEQ ID NO: 9724 - DNA, 486 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 9725 - DNA, 500 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggcagtgagcgcaacgcaattaatgtgagttagctcactcattaggcaccccagggaaggtcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttt

SEQ ID NO: 9726 - DNA, 488 bp, Artificial
  TaSBEIIa allele with mutations introduced by TALEN pair TaSBEIIa_T03
  misc_feature (33): n is a or c or t or g
gagagatagctggattaggcgatcgcgcttccngaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagtccttggccccgtgctggctcttgggccactgaa

SEQ ID NO: 9727 - DNA, 501 bp, Artificial
  TaSBEIIa allele with mutations introduced by TALEN pair TaSBEIIa_T03
gagagatagctggattaggcgatcgcgcttcctgaacctgtattttttcccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagagaaaataccgcatcaggcgccattcgccattcaggctgcgcaactgttggaagggcgatcggtgcgggaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcaattgtgcaggta

SEQ ID NO: 9728 - DNA, 513 bp, Artificial
  TaSBEIIa allele with mutations introduced by TALEN pair TaSBEIIa_T03
gagagatagctggattaggcgatcgcgcttcctgaacctgtattttttccccgcgggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggcgatggccaccacctgctccggggtcaagccgtgggaaggtcctggtgcctgacggcgagagcgacgacttggcaagtccggcgcaacctgaagaattacaggtacacacactcgtgccggtaaatcttcatacaatcgtattcacttaccaaatgccggatgaaaccaaccacggatgcgtcaggtttcgagcttcttctatcagcattgtgcagtactgcactgccttgttctacttttgttagccttggcccccgtgctggtcc

SEQ ID NO: 9729 - DNA, 509 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagaagatcctttttgataatctcatgaccaaaatcccttaacgtgagttttcgttccactgagcgtcaaggtcctggtgcctgacggcgagagcgacgacttggcaagtccggcgcaacctgaagaattacaggtacacacactcgtgccggtaaatcttcatacaatcgttattcacttaccaaatgccggatgaaaccaacacggatgcgtcaggtttcgagcttcttctatcagcattgtgcagtactgcactgccttgttt

SEQ ID NO: 9730 - DNA, 486 bp, Artificial; identical to SEQ ID NO: 8779
  TaSBEIIa allele with mutations introduced by TALEN pair TaSBEIIa_T03

SEQ ID NO: 9731 - DNA, 488 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaacacggatgcgtcaggtttcgagtcttcttctatcagcattgtgcagtactgcactgccttgttctattttgttagtccttggcccccgtgctggctcttgggccactgaa

SEQ ID NO: 9732 - DNA, 487 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagcctttggccccgtgcctggctcttgggccactgaa

SEQ ID NO: 9733 - DNA, 497 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccaacggatgcgtcaggtttcgagcttcttctatcagcattgtgcagtactgcactgccttgttcatttttgttagccttgggccccgtgctgggcttccgttggggcccactcgaaa

SEQ ID NO: 9734 - DNA, 487 bp, Artificial
  TaSBEIIa allele with mutations introduced by TALEN pair TaSBEIIa_T03
gagagatagctggattaggcgatcgcgcttcctgaacctgtatttttttcccgcggggaaatgcgttagtgtcacccaggccctggtgttaccacggctttgatcattcctcgtttcattctgatatatattttctcactctttttcttcctgttcttgctgtaactgcaagttgtggtcgttttttcactattgtagtcatccttgcatttttgcaggcgccgtcctgagccgcgcggcctctccgtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggcccccgtgctgggctcttgggccactgaa

SEQ ID NO: 9735 - DNA, 494 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatatttttctcactctttcttctgttcttgctgtaactgcaagttgtagcattgtctcactattgtagtcatccttgcattgcaggcgccgtcctgagccgcgcggcctctccaggcggcgagatgatcaaggccggcaccctgaccctggaggaggtgaggaggaagttcaacaacggcgagatcaacttcgcggccgactgataactcgagaagggcgcgatcgttcaaacatttggcaatgaaggtcctggtgcctgacggtgagagcgacgacttggcaagtccggcgcaacctgaagaattacaggtacacaccatcgtgccgggaaatcttcatacaatcgttattcacttaccaaatgaccggatagaaaccaagccgcggaggcgtcaggttttgtacg

SEQ ID NO: 9736 - DNA, 486 bp, Artificial; identical to SEQ ID NO: 8861
  TaSBEIIa allele with mutations introduced by TALEN pair TaSBEIIa_T03

SEQ ID NO: 9737 - DNA, 489 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggttcgagcttcttctatcagcattgtgcagtactgcactgccttgttctattttgttagccttggccccgtgctggctcgttcgggcctactgaa

SEQ ID NO: 9738 - DNA, 493 bp, Artificial
  TaSBEIIa allele with mutations introduced by TALEN pair TaSBEIIa_T03
gagagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgtttttttcactattgtagtcatccttgcatttttgcaggcgccgtcctgagccgcgcggcctctccgtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctatttttgttagtccttggccccgtgcttggcttcgttgggccacgtgaa

SEQ ID NO: 9739 - DNA, 485 bp, Artificial
  TaSBEIIa allele with mutations introduced by TALEN pair TaSBEIIa_T03
  misc_feature (324); (419): n is a or c or t or g
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgngccggtaaatcttcatacaatcgttattcacttaccaaatgccggatgaaaccaaccacggatgcgtcaggtttcgagcttctctatcagcattntgcagtactgcactgccttgttcattttgttagccttggccccgtgctggctcttgggccactgaa

SEQ ID NO: 9740 - DNA, 510 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggagaagatcaaaccgaaggttcgttcgacagtggcgcagcaccacgaggcactggtcggccacgggaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgcctttg

SEQ ID NO: 9741 - DNA, 512 bp, Artificial
  TaSBEIIa allele with mutations introduced by TALEN pair TaSBEIIa_T03
gagagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcacagcttgtctgtaagcggatgccgggagccgcgccctgacgggcttgtctgctcccgggaaggtcctggtgcctgacggcgagagcgacgacttggcaagtccggcgcaacctgaagaattacaggtacacacactcgtgccggtaaatcttcatacaatcgttattcacttaccaaatgccggatacgaaaccaaccacggatgcgtcaggtttcgagcttcttctatcagcattgtgcagtactgcactgtccttttcg

SEQ ID NO: 9742 - DNA, 486 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgtattcacttaccaaatgccggatgaaaccaaccacggatgcgtcaggtttccgagcttcttctatcagcattgtgcagtactgcactgccttgttcattttgttagccttggccccgtgctggctcttgggccactgaa

SEQ ID NO: 9743 - DNA, 490 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatagaaaccaaccaccggatgcgtcaggtttcgagcttcttctatcagcattgtgcagtactgcactgccttgttctattttgttagccttggccccgtgctggctcttcgggccacgtgaa

SEQ ID NO: 9744 - DNA, 484 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccatgaa

SEQ ID NO: 9745 - DNA, 489 bp, Artificial
  TaSBEIIa allele with mutations introduced by TALEN pair TaSBEIIa_T03
  misc_feature (386): n is a or c or t or g
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggangcgtcaggttcgagcttcttctatcagcattgtgcagtactgcactgccttgttctattttgttagtccttggccccgtgctggtctcgttgggccactgtaa

SEQ ID NO: 9746 - DNA, 486 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctgggtctcttgggccactgaa

SEQ ID NO: 9747 - DNA, 488 bp, Artificial
  TaSBEIIa allele with mutations introduced by TALEN pair TaSBEIIa_T03
gagagatagctggattaggcgatcgcgcttcctgaacctgttattttttccccgcggggaaatgcgttagtgtcacccaggccctggtgttaccacggctttgatcattcctcgtttcattctgatatatattttctcactctttttcttcctgttacttgctgtaactgcaagttgtggcgttttttcactattgtagtcatccttgcattttgcaggcgccgtcctgagccgcgcggcctctccagggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgtagtccttggccccgtgctggctcttgggccactgaa

SEQ ID NO: 9748 - DNA, 486 bp, Artificial; identical to SEQ ID NO: 8887
  TaSBEIIa allele with mutations introduced by TALEN pair TaSBEIIa_T03

SEQ ID NO: 9749 - DNA, 466 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccatgaa

SEQ ID NO: 9750 - DNA, 491 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagaggtcctccggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagtccttggccccgtgctggctcttgggccactgaa

SEQ ID NO: 9751 - DNA, 492 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcccacggcttgaccccggagcaggtggtggccatcgccagccacgatggcggcaagcaggcgctggagacggaaggtcctggtgcctgacggcgagagcgacgacttggcaagtccggcgcaacctgaagaattacaggtacacacactcgtgccggtaaatcttcatacaatcgttattcacttaccaatgccggatgaaaccaaccacggatgcgtcaggtttcgagtcttcttctatcagcattgtgcagta

SEQ ID NO: 9752 - DNA, 476 bp, Artificial; identical to SEQ ID NO: 8919
  TaSBEIIa allele with mutations introduced by TALEN pair TaSBEIIa_T03

SEQ ID NO: 9753 - DNA, 479 bp, Artificial; identical to SEQ ID NO: 8885
  TaSBEIIa allele with mutations introduced by TALEN pair TaSBEIIa_T03

SEQ ID NO: 9754 - DNA, 488 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagtccttggccccgtgctggctcttgggccacgtgaa

SEQ ID NO: 9755 - DNA, 441 bp, Artificial; identical to SEQ ID NO: 9557
  TaSBEIIa allele with mutations introduced by TALEN pair TaSBEIIa_T03

SEQ ID NO: 9756 - DNA, 499 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagagaaaataccgcatcaggcgccattcgccattcaggctgcgcaactgttgggaagggcgatcggtgcgggaaggtcctggtgcctgacggcgagagcgacgacttggcaagtccggcgcaacctgaagaattacaggtacacacactcgtgccggtaaatcgttcatacaatcgttattcacttaccaaatgccggatgaaccaaccacggatgcgtcaggtttcgagcttcttctatcagcattgtgcagta

SEQ ID NO: 9757 - DNA, 511 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggggtcataacgtgactcccttaattctccgctcatgatcattggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccggttg

SEQ ID NO: 9758 - DNA, 480 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctaggtcctggtgcctgacggcgagagcgacgacttggcaagtccggcgcaacctgaagaattacaggtacacacactcgtgccggtaaatcttcatacaatcgtattcacttaccaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 9759 - DNA, 488 bp, Artificial; identical to SEQ ID NO: 9754
  TaSBEIIa allele with mutations introduced by TALEN pair TaSBEIIa_T03

SEQ ID NO: 9760 - DNA, 488 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagtccttggcccccgtgctggctcttgggccactgaa

SEQ ID NO: 9761 - DNA, 472 bp, Artificial
  TaSBEIIa allele with mutations introduced by TALEN pair TaSBEIIa_T03
gagagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagtccttggccccgtggctggctcttgggccactgaa

SEQ ID NO: 9762 - DNA, 472 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagtccttggcccccgtgctggctcttgggccactgaa

SEQ ID NO: 9763 - DNA, 471 bp, Artificial; identical to SEQ ID NO: 9391
  TaSBEIIa allele with mutations introduced by TALEN pair TaSBEIIa_T03

SEQ ID NO: 9764 - DNA, 515 bp, Artificial
  TaSBEIIa allele with mutations introduced by TALEN pair TaSBEIIa_T03
gagagatagctggattaaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagttgaagccactcagccgcgggtttctggagtttaatgagctaagcacatacgtcagaaaccattattgcgcgttcaaaagtcgcctaaggtcactatcagctagaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcagtcttctt

SEQ ID NO: 9765 - DNA, 488 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgtccttgttctattttgttagtccttggccccgtgctggctcttcgggccactgaa

SEQ ID NO: 9766 - DNA, 486 bp, Artificial; identical to SEQ ID NO: 8779
  TaSBEIIa allele with mutations introduced by TALEN pair TaSBEIIa_T03

SEQ ID NO: 9767 - DNA, 485 bp, Artificial; identical to SEQ ID NO: 8782
  TaSBEIIa allele with mutations introduced by TALEN pair TaSBEIIa_T03

SEQ ID NO: 9768 - DNA, 486 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggacactgaa

SEQ ID NO: 9769 - DNA, 490 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgttttcattctgatatatattttctcactctttttcttcctgttcttgctgtaactgcaagttgtggcgttttttcactattgtagtcatccttgcattttgctaggcgccgtcctgagccgcgcggcctctccaaaggtcctggtgccctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 9770 - DNA, 487 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagtccttggccccgtgctggctcttgggccactga

SEQ ID NO: 9771 - DNA, 503 bp, Artificial
  TaSBEIIa allele with mutations introduced by TALEN pair TaSBEIIa_T03
gagagatagctggattaggcgatcgcgcttcctgaacctgtatttttttccccgcgggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagccttgatcgttgggaaccggagctgaatgaagccataccaaacgacttaattctccgctcatgatcattggatctagatgcattcgcgaggaaggtcctggtgcctgacggcgagagcgacgacttggcaagtccggcgcaacctgaagaattacaggtacacacactcgtgccggtaaatcttcatacatcgttattcacttaccaatgccggatgaaaccaaccacggatgcgtcaggtttcgagcttcttct

SEQ ID NO: 9772 - DNA, 484 bp, Artificial; identical to SEQ ID NO: 8791
  TaSBEIIa allele with mutations introduced by TALEN pair TaSBEIIa_T03

SEQ ID NO: 9773 - DNA, 484 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctgtcctggtgcctgacggcgagagcgacgacttggcaagtccggcgcaacctgaaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagccttggcccccgtgctggctcgttgggcctactgaa

SEQ ID NO: 9774 - DNA, 487 bp, Artificial; identical to SEQ ID NO: 8806
  TaSBEIIa allele with mutations introduced by TALEN pair TaSBEIIa_T03

SEQ ID NO: 9775 - DNA, 504 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagagaaaataccgcatcaggcgccattcgccattcaggctgcgcaactgttgggaagggcgatcggtgcgggaaggtcctggtgcctgacggcgagagcgacgacttggcaagtccggcgcaacctgaacgaattacaggtacacacactcgtgccggtaaatcttcatacaatcgttattcacttaccaaatgccggatcgaaaccaaccacggatgcgtcaggtttcgagcttcttctatcagcattgtgcagtactg

SEQ ID NO: 9776 - DNA, 487 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactcgaa

SEQ ID NO: 9777 - DNA, 484 bp, Artificial
  TaSBEIIa allele with mutations introduced by TALEN pair TaSBEIIa_T03
gagagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccgtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 9778 - DNA, 486 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccggtcctggtgcctgacggcgagagcgacgacttggcaagtccggcgcaacctgaagaattacaaggtacacacactcgtgccggtaaatcttcatacaatcgttattcacttaccaaatgccggatgaaaaccaaccacggatgcgtcaggtttcgagcttcttctatcagcattgtgcagtactgcactgccttgttcattttgttagccttggccccgtgctggctcttgggccactgaa

SEQ ID NO: 9779 - DNA, 445 bp, Artificial
  TaSBEIIa allele with mutations introduced by TALEN pair TaSBEIIa_T03
gagagatagctggattaggcgatcgcctgcgtcagtgtcacccgaggccctggtgttatcacggctttgatcatctcctcccattctgattattttctcacttctttcttctgttcttgctgtaactgcaagttgtagcattgtctcactattgtagtcatccttgcattgcaggcgccgtcctgagccgcgcggcctctccaaggtcctggtgcctgacggtgagagcgacgacttggcaagtccggcgcaacctgaagaattacaggtacacaccatcgtgccgggaaatcttcatacatcgttattcacttaccaaatgccgatgaaaccagccgcggaggcgtcaggttttcagcttcttctatcagcattgtgcagtactgcactgccttgtgctattttggttacgccgttggcccccgtgtcctggctcgttgggacc

SEQ ID NO: 9780 - DNA, 483 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcgtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagtccttggccccgtgctggctcttgggccactgaa

SEQ ID NO: 9781 - DNA, 487 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcgttgggccactgaa

SEQ ID NO: 9782 - DNA, 486 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagtccttggccccgtgctggctcttgggccactgaa

SEQ ID NO: 9783 - DNA, 487 bp, Artificial; identical to SEQ ID NO: 8806
  TaSBEIIa allele with mutations introduced by TALEN pair TaSBEIIa_T03

SEQ ID NO: 9784 - DNA, 488 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcatttttgttagtccttggccccgtgctggctcttgggccactgaa

SEQ ID NO: 9785 - DNA, 528 bp, Artificial
  TaSBEIIa allele with mutations introduced by TALEN pair TaSBEIIa_T03
  misc_feature (255): n is a or c or t or g
gagagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccgggtttttangattagagtcccgcaattatacatttaatacgcgatagaaaacaaaatatagcgcgcaaactaggataaattatcgcgcgcggtgtcatctatgttactagatcgggaattcgtaaataaaggtcctggtgcctgacggcgagagcgacgacttggcaagtccggcgcaacctgaagaattacaggtacacacactcgtgccggtaaatcttcatacaatcgttattcacttacaaatgccggatgaaaccaacacggatgcgtcaggtttcg

SEQ ID NO: 9786 - DNA, 487 bp, Artificial
  TaSBEIIa allele with mutations introduced by TALEN pair TaSBEIIa_T03
gagagatagctggattaggcgatcgcctgcgtcagtgtcacccaggcccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaggcggcgagatgatcaaggccggcaccctgaccctggaggaggtgaggaggaagttcaacaacggcgagatcaacttcgcggccgactgataactcgagaagggcgcgatcgttcaaacatttggcaatgaaggtcctggtgcctgacggtgagagcgacgacttggcaagtccggcgcaacctgaagaattacaggtacacacatcgtgcggaatcttcatacaatcgttattctactacaatgccgatcgaaaccaagccgacggaggcgtctaggtttgtacg

SEQ ID NO: 9787 - DNA, 526 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccgggtttttatgattagagtcccgcaattatacatttaatacgcgatagaaaaacaaaatatagcgcgcaaaactaggaataaattatcgcgcgcggtgtcatctatgttactagatcgggaattcgtaataaaggtcctggtgcctgacggcgagagcgacgacttggcaagtccggcgcaacctgaagaattacaggtacacacactcgtgccggtaaatcttcatacaatcgttatcacttaccaaatgcggatgaaaccacacggatgctcaggtttcg

SEQ ID NO: 9788 - DNA, 191 bp, Artificial
  TaSBEIIa allele with mutations introduced by TALEN pair TaSBEIIa_T03
gagagatagctggattaggcgatcgcctgcgtcagtgtcacccaggccctggtgttatcacggcttaccaatgccggatgaaccaagccgcggaggcgtcaggtttgagcttcttctatcagcattgtgcagtactgcactgccttgtgcattttgtagccgtggcccgtgctggctcttgggccactgaa

SEQ ID NO: 9789 - DNA, 400 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatatttctcactctttcttctgttcttgctgtaactgcaagttgtagcattgtctcactattgtagtcatccttgcattgcaggcgccgtcctgagccgcgcggcctggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttgtagccgtggccccgtgctggctcttgggccactgaa

SEQ ID NO: 9790 - DNA, 194 bp, Artificial
  TaSBEIIa allele with mutations introduced by TALEN pair TaSBEIIa_T03
gagagatagctggattaggcgatcgcctgcgtcagtgtcacccaggccctggtgttatcacggcttaccaaatgccggatgaaccaagccgcggaggcgtcaggtttgagcttcttctatcagcattgtgcagtactgcactgccttgtgcattttgttagccgtggccccgtgctggctcttgggccactgaa

SEQ ID NO: 9791 - DNA, 202 bp, Artificial
  TaSBEIIa allele with mutations introduced by TALEN pair TaSBEIIa_T03
gagagatagctggattaggcgatcgcctgcgtcagtgtcacccaggccctttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 9792 - DNA, 359 bp, Artificial
  TaSBEIIa allele with mutations introduced by TALEN pair TaSBEIIa_T03
gagagatagctggattaggcgatcgcctcaggccctggtgttaccacggctttgatcatctcctcctttcatgctgatattttctcactctttcttctgttcttgctgtaactgcaagttgtagcattgtctcactattgtagtcatccttgcattgcaggcgccgtcaacctgaagaattacaggtacacaccatcgtgccgggaaatcttcatacaatcgttattcacttaccaaatgccggatgaaaccaagccgcggaggcgtcaggtttgagcttcttctatcagcattgtgcagtactgcactgccttgtgcatttgtagccgtggccccgtgctggctcttgggccactgaa

SEQ ID NO: 9793 - DNA, 435 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatatttctcactctttcttctgttcttgctgtaactgcaagttgtagcattgtctcactattgtagtcatccttgcattgcaggcgccgtcctgagccgcgcgggaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 9794 - DNA, 198 bp, Artificial
  TaSBEIIa allele with mutations introduced by TALEN pair TaSBEIIa_T03
gagagatagctggattaggcgatcgcctgcgtcagtgtcacccaggcctcatacaatcgttattcacttaccaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 9795 - DNA, 279 bp, Artificial
  TaSBEIIa allele with mutations introduced by TALEN pair TaSBEIIa_T03
gagagatagctggattaggcgatcgcctcaggccctggtgttaccacggctttgatcatctcctcctttcatgctgatatttctcactctttcttctgttcttgctgtaactgcaagttgtagcattgtctcactattgtagtcatccttgccaaatgccggatgaaaccaagccgcggaggcgtcaggttttgagcttcttctatcagcattgtgcagtactgcactgccttgtgcattttgttagccgtggcccgtgctggctcttgggccactgaa

SEQ ID NO: 9796 - DNA, 329 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatatttctcactctttcttctgttcttgctgtaactgcaagttgtagcattgtctcactattgtagtcatcctccatcgtgccgggaaatcttcatacaatcgttattcacttaccaaatgccggatgaaaccaagccgcggaggcgtcaggtttgagcttcttctatcagcattgtgcagtactgcactgccttgtgcattttgttagccgtggccccgtgctggctcttgggccactgaa

SEQ ID NO: 9797 - DNA, 429 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatatttctcactctttcttctgttcttgctgtaactgcaagttgtagcattgtctcactattgtagtcatccttgcattgcaggcgccgtcctgagccgcgcggcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 9798 - DNA, 311 bp, Artificial
  TaSBEIIa allele with mutations introduced by TALEN pair TaSBEIIa_T03
gagagatagctggattaggcgatcgcctcaggccctggtgttaccacggctttgatcatctcctcccattctgatattttctcactctttcttctgttcttgctgtaactgcaagttgtagcattgtctcactaggtacacaccatcgtgccgggaaatcttcatacaatcgttattcacttaccaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 9799 - DNA, 194 bp, Artificial; identical to SEQ ID NO: 9790
  TaSBEIIa allele with mutations introduced by TALEN pair TaSBEIIa_T03

SEQ ID NO: 9800 - DNA, 251 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccaccatcgtgccggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 9801 - DNA, 196 bp, Artificial
  TaSBEIIa allele with mutations introduced by TALEN pair TaSBEIIa_T03
gagagatagctggattaggcgatcgcctgcgtcagtgtcacccaggccctggtgttatcacggcttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 9802 - DNA, 202 bp, Artificial; identical to SEQ ID NO: 9791
  TaSBEIIa allele with mutations introduced by TALEN pair TaSBEIIa_T03

SEQ ID NO: 9803 - DNA, 198 bp, Artificial
  TaSBEIIa allele with mutations introduced by TALEN pair TaSBEIIa_T03
gagagatagctggattaggcgatcgcctgcgtcagtgtcacccaggcctcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 9804 - DNA, 196 bp, Artificial; identical to SEQ ID NO: 9801
  TaSBEIIa allele with mutations introduced by TALEN pair TaSBEIIa_T03

SEQ ID NO: 9805 - DNA, 195 bp, Artificial
  TaSBEIIa allele with mutations introduced by TALEN pair TaSBEIIa_T03
gagagatagctggattaggcgatcgccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 9806 - DNA, 200 bp, Artificial
  TaSBEIIa allele with mutations introduced by TALEN pair TaSBEIIa_T03
gagagatagctggattaggcgatcgcctcaccgtcgtgccggaaaatcttcatgcacccgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 9807 - DNA, 195 bp, Artificial; identical to SEQ ID NO: 9805
  TaSBEIIa allele with mutations introduced by TALEN pair TaSBEIIa_T03

SEQ ID NO: 9808 - DNA, 196 bp, Artificial; identical to SEQ ID NO: 9801
  TaSBEIIa allele with mutations introduced by TALEN pair TaSBEIIa_T03

SEQ ID NO: 9809 - DNA, 422 bp, Artificial
  TaSBEIIa allele with mutations introduced by TALEN pair TaSBEIIa_T03
gagagatagctggattaggcgatcgcctgcgtcagtgtcactcaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 9810 - DNA, 420 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatatttctcactctttcttctgttcttgctgtaactgcaagttgtagcattgtctcactattgtagtcatccttgcattgcaggcgccgtcctgagctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 9811 - DNA, 199 bp, Artificial
  TaSBEIIa allele with mutations introduced by TALEN pair TaSBEIIa_T03
gagagatagctggattaggcgatcgcctgcgtcagtgtcacccaggcctcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 9812 - DNA, 251 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggcactgaa

SEQ ID NO: 9813 - DNA, 373 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatatttctcactctttcttctgttcttgctgtaactgcaagttgtagcattgtctcactattgtagtcatccttgcattggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 9814 - DNA, 195 bp, Artificial; identical to SEQ ID NO: 9805
  TaSBEIIa allele with mutations introduced by TALEN pair TaSBEIIa_T03

SEQ ID NO: 9815 - DNA, 243 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatatttctcatacaatcgttattcacttaccaaatgccggatgaaaccaagccgcggaggcgtcaggtttgagcttcttctatcagcattgtgcagtactgcactgccttgtgcattttgttagccgtggcccgtgctggctcttgggccactgaa

SEQ ID NO: 9816 - DNA, 329 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatatttctcactctttcttctgttcttgctgtaactgcaagttgtagcattgtctcactattgtagtcatccttgcattgcagggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 9817 - DNA, 273 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatatttctcactctttcttctgttcttgctgtaactgcaagttgtagcattgtctcaccaaatgccggatgaaaccaagccgcggaggcgtcaggtttgagcttcttctatcagcattgtgcagtactgcactgccttgtgcattttgttagccgttggccccgtgctggctcttgggccactgaa

SEQ ID NO: 9818 - DNA, 433 bp, Artificial
  TaSBEIIa allele with mutations introduced by TALEN pair TaSBEIIa_T03
  misc_feature (174): n is a or c or t or g
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcnccgtcctgagccgcgcggcctctctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 9819 - DNA, 199 bp, Artificial; identical to SEQ ID NO: 9811
  TaSBEIIa allele with mutations introduced by TALEN pair TaSBEIIa_T03

SEQ ID NO: 9820 - DNA, 373 bp, Artificial; identical to SEQ ID NO: 9813
  TaSBEIIa allele with mutations introduced by TALEN pair TaSBEIIa_T03

SEQ ID NO: 9821 - DNA, 469 bp, Artificial
  TaSBEIIa allele with mutations introduced by TALEN pair TaSBEIIa_T03
gagagatagctggattaggcgatcgcgcttcctgaacctgtatttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcagcttcttctatcagcattgtgcagtactgcactgccttgttcattttgttagccttggccccgtgctggctcttgggccactgaa

SEQ ID NO: 9822 - DNA, 477 bp, Artificial
  TaSBEIIa allele with mutations introduced by TALEN pair TaSBEIIa_T03
gagagatagctggattaggcgatcgcgcttcctgaacctgtatttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 9823 - DNA, 416 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgcggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 9824 - DNA, 402 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcgtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgcccttgtgcattttgtagccgtggccccgtgctggctcttgggccactga

SEQ ID NO: 9825 - DNA, 196 bp, Artificial; identical to SEQ ID NO: 9801
  TaSBEIIa allele with mutations introduced by TALEN pair TaSBEIIa_T03

SEQ ID NO: 9826 - DNA, 263 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatatttctcactctttcttctgttcttgctgtaactgcaagttgtagcattgtctcactattgtagtcatccgcggaggcgtcaggttttgagcttcttctatcagcattgtgcagtactgcactgccttgtgcatttgttagccgtggccccgtgctggctcttgggccactgaa

SEQ ID NO: 9827 - DNA, 407 bp, Artificial
  TaSBEIIa allele with mutations introduced by TALEN pair TaSBEIIa_T03
gagagatagctggattagggcgatcgcctgcgtcagtgtcacccaggccctggtgttatcacggctttgatcatctcctcccattctgatatttctcactctttcttctgttcttgctgtaactgcaagttgtagcattgtctcactattgtagtcatccttgcattgcaggcgccgtcctgagccgcgcggcgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgttagccgtggccccgtgctggctcttgggccactgaa

SEQ ID NO: 9828 - DNA, 191 bp, Artificial; identical to SEQ ID NO: 9788
  TaSBEIIa allele with mutations introduced by TALEN pair TaSBEIIa_T03

SEQ ID NO: 9829 - DNA, 444 bp, Artificial
  TaSBEIIa allele with mutations introduced by TALEN pair TaSBEIIa_T03
gagagatagctggattaggcgatcgcctcaggccctggtgttaccacggctttgatcatctcctcctttcatgctgatattttctcactctttcttctgttcttgctgtaactgcaagttgtagctatttttttggcaaataagttgtagcattgtctcagtattgtactcatccttgcatttgcaggcgccgtcctgagccgcgcggctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 9830 - DNA, 394 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatatttctcactctttcttctgttcttgctgtaactgcaagttgtagcattgtctcactattgtagtcatccttgcattgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 9831 - DNA, 199 bp, Artificial; identical to SEQ ID NO: 9811
  TaSBEIIa allele with mutations introduced by TALEN pair TaSBEIIa_T03

SEQ ID NO: 9832 - DNA, 278 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatatttctcactctttcttctgttcttgctgtaactgcaagttgtagcattgtctcactattgtagtcatccttgcattgcaggcgccgtccgcgtcaggttttgagcttcttctatcagcattgtgcagtactgcactgccttgtgcattttgttagccgtggccccgtgctggctcttgggccactgaa

SEQ ID NO: 9833 - DNA, 322 bp, Artificial
  TaSBEIIa allele with mutations introduced by TALEN pair TaSBEIIa_T03
gagagatagctggattaggcgatcgcctcaggccctggtgttaccacggctttgatcatctcctcctttcatgctgatattttctcactctttcttctgttcttgctgtaactgcaagttgtggcgtttttcactattgtagtcatccttgcacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 9834 - DNA, 246 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatatttctcatacaatcgttattcacttaccaaatgccggatgaaaccaagccgcggaggcgtcaggttttgagcttcttctatcagcattgtgcagtactgcactgccttgtgctattttgttagccgtggccccgtgctggctcttgggccactgaa

SEQ ID NO: 9835 - DNA, 194 bp, Artificial
  TaSBEIIa allele with mutations introduced by TALEN pair TaSBEIIa_T03
gagagatagctggattaggcgatcaccatcgtgccgggaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 9836 - DNA, 388 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttgttagccgtggccccgtgctggctcttgggccactgaa

SEQ ID NO: 9837 - DNA, 328 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatatttctcactctttcttctgttcttgctgtaactgcaagttgtagcattgtctcactattgtagtcatcaccatcgtgccgggaaatcttcatacaatcgttatcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 9838 - DNA, 196 bp, Artificial; identical to SEQ ID NO: 9801
  TaSBEIIa allele with mutations introduced by TALEN pair TaSBEIIa_T03

SEQ ID NO: 9839 - DNA, 434 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcgggaaggtcctggtgcctgacggcgagagcgacgacttggcaagtccggcgcaacctgaagaattacaggtacacacactcgtgccggtaaatcttcatacaatcgttattcacttaccaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 9840 - DNA, 403 bp, Artificial
  TaSBEIIa allele with mutations introduced by TALEN pair TaSBEIIa_T03
gagagatagctggattaggcgatcgcctcaggccctggtgttaccacggctttgatcattcctcgtttcattctgatatatattttctcactcttttcttcctgttcttgctgtaactgcaagttgtggcgtttttcactattgtagtcatccttgcattttgcaggcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcatttgttagccttggccccgtgctggctcttgggccactgaa

SEQ ID NO: 9841 - DNA, 329 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatatttctcactctttcttctgttcttgctgtaactgcaagttgtagcattgtctcactattgtagtcatcctccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 9842 - DNA, 384 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 9843 - DNA, 195 bp, Artificial; identical to SEQ ID NO: 9805
  TaSBEIIa allele with mutations introduced by TALEN pair TaSBEIIa_T03

SEQ ID NO: 9844 - DNA, 412 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggccgcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 9845 - DNA, 291 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatatttctcactctttcttctgttcttgctgtaactgcaagttgtagcattgtctcactattgtagtcatccttgccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 9846 - DNA, 327 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatatttctcactctttcttctgttcttgctgtaactgcaagttgtagcattgtctcactattgtagtcatcctccatcgtgccgggaatcttcatacaatcgttattcacttaccaatgccggatgaaaccaagccgcggaggcgtcaggtttgagcttcttctatcagcattgtgcagtactgcactgccttgtgcattttgttagccgtggccccgtgctggctcttgggccactgaa

SEQ ID NO: 9847 - DNA, 196 bp, Artificial; identical to SEQ ID NO: 9801
  TaSBEIIa allele with mutations introduced by TALEN pair TaSBEIIa_T03

SEQ ID NO: 9848 - DNA, 196 bp, Artificial; identical to SEQ ID NO: 9801
  TaSBEIIa allele with mutations introduced by TALEN pair TaSBEIIa_T03

SEQ ID NO: 9849 - DNA, 369 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 9850 - DNA, 265 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactcgtgccgggaaatcttcatacaatcgttattcacttaccaaatgccggatgaaaccaagccgcggaggcgtcaggttttgagcttcttctatcagcattgtgcagtactgcactgccttgtgcatttgttagccgtggccccgtgctggctcttgggccactgaa

SEQ ID NO: 9851 - DNA, 379 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 9852 - DNA, 199 bp, Artificial
  TaSBEIIa allele with mutations introduced by TALEN pair TaSBEIIa_T03
gagagatagctggattaggcgatcgcctgcgtcagtgtcacccaggcctcatacaatcgttattcacttaccaatgccggatgaaaccaagccgcggaggcgtcaggttttgagcttcttctatcagcattgtgcagtactgcactgccttgtgctattttgttagccgtggccccgtgctggctcttgggccactgaa

SEQ ID NO: 9853 - DNA, 202 bp, Artificial; identical to SEQ ID NO: 9791
  TaSBEIIa allele with mutations introduced by TALEN pair TaSBEIIa_T03

SEQ ID NO: 9854 - DNA, 201 bp, Artificial
  TaSBEIIa allele with mutations introduced by TALEN pair TaSBEIIa_T03
gagagatagctggattaggcgatcgcctgcgtcagtgtcacccaggccctttcatacaatcgttattcacttaccaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 9855 - DNA, 196 bp, Artificial; identical to SEQ ID NO: 9801
  TaSBEIIa allele with mutations introduced by TALEN pair TaSBEIIa_T03

SEQ ID NO: 9856 - DNA, 468 bp, Artificial
  TaSBEIIa allele with mutations introduced by TALEN pair TaSBEIIa_T03
gagagatagctggattaggcgatcgcgcttcctgaacctgtatttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 9857 - DNA, 196 bp, Artificial; identical to SEQ ID NO: 9801
  TaSBEIIa allele with mutations introduced by TALEN pair TaSBEIIa_T03

SEQ ID NO: 9858 - DNA, 425 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgcctggctcgttgggccactgaa

SEQ ID NO: 9859 - DNA, 244 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttaccaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 9860 - DNA, 292 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatatttctcactctttcttctgttcttgctgtaactgcaagttgtagcattgtctcactacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 9861 - DNA, 196 bp, Artificial
  TaSBEIIa allele with mutations introduced by TALEN pair TaSBEIIa_T03
gagagatagctggattaggcgatcgccatcgtgccgggaaatcttcatacaatcgttattcacttaccaaatgccggatgaaaccaagccgcggaggcgtcaggttttgagcttcttctatcagcattgtgcagtactgcactggccttgtgcattttgttagccgtggccccgtgctggctcttgggccactgaa

SEQ ID NO: 9862 - DNA, 199 bp, Artificial; identical to SEQ ID NO: 9811
  TaSBEIIa allele with mutations introduced by TALEN pair TaSBEIIa_T03

SEQ ID NO: 9863 - DNA, 195 bp, Artificial
  TaSBEIIa allele with mutations introduced by TALEN pair TaSBEIIa_T03
gagagatagctggattaggcgatcgcctgcgtcagtgtcacccaggccctggtgttatcacggcttaccaaatgccggatgaaaccaagccgcggaggcgtcaggtttgagcttcttctatcagcattgtgcagtactgcactgccttgtgcattttgttagccgtggccccgtgctggctcttgggccactgaa

SEQ ID NO: 9864 - DNA, 326 bp, Artificial
  TaSBEIIa allele with mutations introduced by TALEN pair TaSBEIIa_T03
gagagatagctggattagggcgatcgcctgcgtcagtgtcacccaggccctggtgttatcacggctttgatcatctcctcccattctgatattttctcactctttcttctgttcttgctgtaactgcaagttgtagcctgaagaattacaggtacacaccatcgtgccgggaaatcttcatacaatcgttattcacttaccaaatgccggatgaaaccaagccgcggaggcgtcaggtttgagcttcttctatcagcattgtgcagtactgcactgccttgtgcattttgtagccgtggccccgtgctggctcttgggccactgaa

SEQ ID NO: 9865 - DNA, 328 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatatttctcactctttcttctgttcttgctgtaactgcaagttgtagcattgtctcactattgtagtcatcctccatcgtgccgggaaatcttcatacaatcgttattcacttaccaaatgccggatgaaaccaagccgcggaggcgtcaggtttgagcttcttctatcagcattgtgcagtactgcactgccttgtgcattttgtagccgtggccccgtgctggctcttgggccactgaa

SEQ ID NO: 9866 - DNA, 474 bp, Artificial
  TaSBEIIa allele with mutations introduced by TALEN pair TaSBEIIa_T03
gagagatagctggattaggcgatcgcgcttcctgaacctgtatttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggccctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 9867 - DNA, 442 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccagggtcctggtgcctgacggtgagagcgacgacttggcaagtccggcgcaacctgaagaattacaggtacacaccatcgtgccgggaaatcttcatacaatcgttattcacttaccaatgccggatgaaaccaagccgcggaggcgtcaggtttgagcttcttctatcagcattgtgcagtactgcactgccttgtgctattttgttagccgtggccccgtgctggctcgttgggccactgaa

SEQ ID NO: 9868 - DNA, 195 bp, Artificial; identical to SEQ ID NO: 9805
  TaSBEIIa allele with mutations introduced by TALEN pair TaSBEIIa_T03

SEQ ID NO: 9869 - DNA, 437 bp, Artificial
  TaSBEIIa allele with mutations introduced by TALEN pair TaSBEIIa_T03
gagagatagctggattaggcgatcgcgcttcctgaacctgtattttttcccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcagcaagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 9870 - DNA, 376 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatatttctcactctttcttctgttcttgctgtaactgcaagttgtagcattgtctcactattgtagtcatccttgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 9871 - DNA, 199 bp, Artificial; identical to SEQ ID NO: 9811
  TaSBEIIa allele with mutations introduced by TALEN pair TaSBEIIa_T03

SEQ ID NO: 9872 - DNA, 378 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatatttctcactctttcttctgttcttgctgtaactgcaagttgtagcattgtctcactattgtagtcatccttgcattgcaggcgccgtcctgagcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttggggccactgaa

SEQ ID NO: 9873 - DNA, 202 bp, Artificial; identical to SEQ ID NO: 9791
  TaSBEIIa allele with mutations introduced by TALEN pair TaSBEIIa_T03

SEQ ID NO: 9874 - DNA, 195 bp, Artificial; identical to SEQ ID NO: 9805
  TaSBEIIa allele with mutations introduced by TALEN pair TaSBEIIa_T03

SEQ ID NO: 9875 - DNA, 374 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatatttctcactctttcttctgttcttgctgtaactgcaagttgtagcattgtctcactattgtagtcatccttgcattggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttggggccactgaa

SEQ ID NO: 9876 - DNA, 195 bp, Artificial
  TaSBEIIa allele with mutations introduced by TALEN pair TaSBEIIa_T03
gagagatagctggattaggcgatcaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 9877 - DNA, 427 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgtgcattttgttagccgtggccccgtgctggctcttgggccactgaa

SEQ ID NO: 9878 - DNA, 365 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatatttctcactctttcttctgttcttgctgtaactgcaagttgtagcattgtctcactattgtagtcatccttgcattgcaggacaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgtcattttgttagccttggccccgtgctggctcttgggccactgaa

SEQ ID NO: 9879 - DNA, 426 bp, Artificial
  TaSBEIIa allele with mutations introduced by TALEN pair TaSBEIIa_T03
gagagatagctggattaggcgatcgcctcaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaggtcctggtgcctgacggcgagagcgacgacttggcaagtccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggccactgaa

SEQ ID NO: 9880 - DNA, 376 bp, Artificial; identical to SEQ ID NO: 9870
  TaSBEIIa allele with mutations introduced by TALEN pair TaSBEIIa_T03

SEQ ID NO: 9881 - DNA, 423 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcgtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 9882 - DNA, 291 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgtgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 9883 - DNA, 263 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatatttctcactctttcttctgttcttgctgtaactgcaagttgtagcattgtctcactattgtagtcatccgcggaggcgtcaggttttgagcttcttctatcagcattgtgcagtactgcactgccttgtgcattttgtagccgtggccccgtgctggctcttgggccactgaa

SEQ ID NO: 9884 - DNA, 440 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccagggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggtttgagcttcttctatcagcattgtgcagtactgcactgccttgtgcattttgtagccgtggccccgtgctggctcttgggccactgaa

SEQ ID NO: 9885 - DNA, 406 bp, Artificial
  TaSBEIIa allele with mutations introduced by TALEN pair TaSBEIIa_T03
gagagatagctggattagggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 9886 - DNA, 334 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatatttctcactctttcttctgttcttgctgtaactgcaagttgtagcattgtctcactattgtagtcatccttgcattgcaggcgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 9887 - DNA, 406 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 9888 - DNA, 202 bp, Artificial; identical to SEQ ID NO: 9791
  TaSBEIIa allele with mutations introduced by TALEN pair TaSBEIIa_T03

SEQ ID NO: 9889 - DNA, 478 bp, Artificial
  TaSBEIIa allele with mutations introduced by TALEN pair TaSBEIIa_T03
gagagatagctggattaggcgatcgcgcttcctgaacctgtatttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 9890 - DNA, 368 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatatttctcactctttcttctgttcttgctgtaactgcaagttgtagcattgtctcactattgtagtcatccttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 9891 - DNA, 194 bp, Artificial
  TaSBEIIa allele with mutations introduced by TALEN pair TaSBEIIa_T03
gagagatagctggattaggcgatcgccatcgtgccgggaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 9892 - DNA, 304 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttgttagccgtggccccgtgctggctcttgggccactgaa

SEQ ID NO: 9893 - DNA, 262 bp, Artificial
  TaSBEIIa allele with mutations introduced by TALEN pair TaSBEIIa_T03
gagagatagctggattaggcgatcgcctcaggccctggtgttaccacggctttgatcatctcctcctttcatgctgatattttctcactctttcttctgttcttgctgtaactgcaagttgcgttattcacttaccaaatatcggatgaaccaagccgcggaggcatcaggtttcaagcttcttctatcagcattgtgcactacttcactgccttgtgcagtttgttagctgtggccccgcgctggctcttgggccactgaa

SEQ ID NO: 9894 - DNA, 399 bp, Artificial
  TaSBEIIa allele with mutations introduced by TALEN pair TaSBEIIa_T03
gagagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcaagtccggcgcaacctgaagaattacaggtacacacactcgtgccggtaaatcttcatacaatcgttattcacttaccaaatgccggatgaaaccaaccacggatgcgtcaggttttcgagcttcttctatcagcattgtgcagtactgcactgccttgttcattttgttagccttggccccgtgctggctcttgggccactgaa

SEQ ID NO: 9895 - DNA, 201 bp, Artificial
  TaSBEIIa allele with mutations introduced by TALEN pair TaSBEIIa_T03
gagagatactggattaggcgatcgcctgcgtcagtgtcacccaggccctttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 9896 - DNA, 421 bp, Artificial
  TaSBEIIa allele with mutations introduced by TALEN pair TaSBEIIa_T03
gagagatagctggattaggcgatcgcgcttcctgaacctgtatttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtccggcgcaacctgaagaattacaggtacacaccatcgtgccgggaaatcttcatacaatcgttattcacttaccaaatgccggatgaaaccagccgcggaggcgtcaggttttgagcttcttctatcagcattgtgcagtactgcactgccttgtgcattttgtagccgtggccccgtgctggctcttgggccactgaa

SEQ ID NO: 9897 - DNA, 460 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgcggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 9898 - DNA, 305 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 9899 - DNA, 265 bp, Artificial
  TaSBEIIa allele with mutations introduced by TALEN pair TaSBEIIa_T03
gagagatagctggattaggcgatcgcctcaggccctggtgttaccacggctttgatcatctcctcctttcatgctgatattttctcactctttcttctgttcttgctgtaactgcaagttgtagcattattcacttaccaaatatcggatgaaccaagccgcggaggcatcaggtttcaagcttcttctatcagcattgtgcagtactgcactgccttgtgcattttgttagccgtggccccgtgctggctcttgggccactgaa

SEQ ID NO: 9900 - DNA, 195 bp, Artificial; identical to SEQ ID NO: 9805
  TaSBEIIa allele with mutations introduced by TALEN pair TaSBEIIa_T03

SEQ ID NO: 9901 - DNA, 383 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 9902 - DNA, 196 bp, Artificial; identical to SEQ ID NO: 9801
  TaSBEIIa allele with mutations introduced by TALEN pair TaSBEIIa_T03

SEQ ID NO: 9903 - DNA, 306 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgttagccgtggccccgtgctggctcttgggccactgaa

SEQ ID NO: 9904 - DNA, 262 bp, Artificial; identical to SEQ ID NO: 9893
  TaSBEIIa allele with mutations introduced by TALEN pair TaSBEIIa_T03

SEQ ID NO: 9905 - DNA, 312 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 9906 - DNA, 202 bp, Artificial; identical to SEQ ID NO: 9791
  TaSBEIIa allele with mutations introduced by TALEN pair TaSBEIIa_T03

SEQ ID NO: 9907 - DNA, 419 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagcctgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 9908 - DNA, 379 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccaagtccggcgcaacctgaagaattacaggtacacaccatcgtgccggaaatcttcatacaatcgttattcacttaccaaatgccggatgaaaccagccgcggaggcgtcaggttttgagcttcttctatcagcattgtgcagtactgcactgccttgtgcattttgtagccgtggccccgtgctggctcttggggccactgaa

SEQ ID NO: 9909 - DNA, 433 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattttgcaggcgccgtcctgagccgcgcggctcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 9910 - DNA, 194 bp, Artificial
  TaSBEIIa allele with mutations introduced by TALEN pair TaSBEIIa_T03
gagagatagctggattaggcgatcaccatcgtgccggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 9911 - DNA, 427 bp, Artificial
  TaSBEIIa allele with mutations introduced by TALEN pair TaSBEIIa_T03
gagagatagctgattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgccctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 9912 - DNA, 334 bp, Artificial
  TaSBEIIa allele with mutations introduced by TALEN pair TaSBEIIa_T03
gagagatagctggattagggcgatcgcctgcgtcagtgtcacccaggccctggtgttatcacggctttgatcatctcctcccattctgatatttctcactctttcttctgttcttgctgtaactgcaagttgtagcattgtctcactattgtagtcatccttgcaccatcgtgccgggaaatcttcatacaatcgttattcacttaccaaatgccggatgaaaccaagccgcggaggcgtcaggtttgagcttcttctatcagcattgtgcagtactgcactgccttgtgctattttgtagccgtggccccgtgctggctcttgggccactgaa

SEQ ID NO: 9913 - DNA, 443 bp, Artificial
  TaSBEIIa allele with mutations introduced by TALEN pair TaSBEIIa_T03
gagagatagctggattaggcgatcgcgcttcctgaacctgtatttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttctctatcagcattgtgcagtactgcactgccttgttcattttgtagccttggccccgtgctggctcttgggccactgaa

SEQ ID NO: 9914 - DNA, 431 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 9915 - DNA, 325 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggcccgtgctggctcttgggccactgaa

SEQ ID NO: 9916 - DNA, 478 bp, Artificial
  TaSBEIIa allele with mutations introduced by TALEN pair TaSBEIIa_T03
gagagatagctggattaggcgatcgcgcttcctgaacctgtatttttcccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcgggaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 9917 - DNA, 195 bp, Artificial
  TaSBEIIa allele with mutations introduced by TALEN pair TaSBEIIa_T03
gagagatagctggattaggcgatcgccatcgtgccgggaaatcttcatacaatcgttattcacttaccaaatgccggatgaaaccaagccgcggaggcgtcaggttttgagcttcttctatcagcattgtgcactacttcactgccttgtgcagtttgttagctgtggccccgcgctggctcttgggccactgaa

SEQ ID NO: 9918 - DNA, 284 bp, Artificial
  TaSBEIIa allele with mutations introduced by TALEN pair TaSBEIIa_T03
gagagatagctggattagcgatcgcctgcgtcagtgtcacccaggccctggtgttatcacggctttgatcatctcctcccattctgatattttctcactctttcttctgttcttgctgtaactgcaagttgtatcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 9919 - DNA, 293 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatatttctcactctttcttctgttcttgctgtaactgcaagttgtagcattgtctcactacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 9920 - DNA, 416 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagcctgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggtttgagcttcttctatcagcattgtgcagtactgcactgccttgtgcatttgtagccgtggccccgtgctggctcttgggccactgaa

SEQ ID NO: 9921 - DNA, 261 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatatttctcactctttcttctgttcttgctgtaactgcaagttgtagcattgtctcactattgtagtcatccgcggaggcgtcaggttttgagcttcttctatcagcattgtgcagtactgcactgccttgtgcatttgtagccgtggcccgtgctggctcttgggccactgaa

SEQ ID NO: 9922 - DNA, 323 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgaattacaggtacacaccatcgtgccgggaaatcttcatacaatcgttattcacttaccaaatgccggatgaaaccaagccgcggaggcgtcaggtttgagcttcttctatcagcattgtgcagtactgcactgccttgtgcattttgtagccgtggccccgtgctggctcttgggccactgaa

SEQ ID NO: 9923 - DNA, 434 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaggggcctgacggtgagagcgacgacttggcaagtccggcgcaacctgaagaattacaggtacacaccatcgtgccgggaaatcttcatacaatcgttattcacttaccaaatgccgatgaaaccagccgcggaggcgtcaggttttgagcttcttctatcagcattgtgcagtactgcactgccttgtgcattttgttagccgtggccccgtgctggctcttgggccacgtgaa

SEQ ID NO: 9924 - DNA, 314 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 9925 - DNA, 202 bp, Artificial; identical to SEQ ID NO: 9791
  TaSBEIIa allele with mutations introduced by TALEN pair TaSBEIIa_T03

SEQ ID NO: 9926 - DNA, 195 bp, Artificial; identical to SEQ ID NO: 9876
  TaSBEIIa allele with mutations introduced by TALEN pair TaSBEIIa_T03

SEQ ID NO: 9927 - DNA, 377 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgttggccccgtgctggctcttggggccactgaa

SEQ ID NO: 9928 - DNA, 248 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgcttaccaaatgccggatgaaaccaagccgcggaggcgtcaggttttgagcttcttctatcagcattgtgcagtactgcactgccttgtgcattttgttagccgtggcccgtgctggctcttgggccactgaa

SEQ ID NO: 9929 - DNA, 404 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcgacgacttggcaagtccggcgcaacctgaagaattacaggtacacaccatcgtgccgggaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 9930 - DNA, 428 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgacgacttggcaagtccggcgcaacctgaagaattacaggtacacacactcgtgccggtaaatcttcatacaatcgttattcacttaccaaatgccggatgaaaccaaccacggatgcgtcaggttttcgagcttcttctatcagcattgtgcagtactgcactgccttgttcattttgttagccttggccccgtgctggctcttgggccactgaa

SEQ ID NO: 9931 - DNA, 378 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttggggccactgaa

SEQ ID NO: 9932 - DNA, 429 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggacttggcaagtccggcgcaacctgaagaattacaggtacacacactcgtgccggtaaatcttcatacaatcgttattcacttaccaaatgccggatgaaaccaaccacggatgcgtcaggttttcgagcttcttctatcagcattgtgcagtactgcactgccttgttcattttgttagccttggccccgtgctggctcttgggccactgaa

SEQ ID NO: 9933 - DNA, 470 bp, Artificial
  TaSBEIIa allele with mutations introduced by TALEN pair TaSBEIIa_T03
gagagatagctggattaggcgatcgcgcttcctgaacctgtatttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggcggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 9934 - DNA, 348 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 9935 - DNA, 399 bp, Artificial
  TaSBEIIa allele with mutations introduced by TALEN pair TaSBEIIa_T03
gagagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtccactccagcgcaacccgaagaattacaggtacacaccgtcgtgccggaaaatcttcatgcacccgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 9936 - DNA, 329 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatatttctcactctttcttctgttcttgctgtaactgcaagttgtagcattgtctcactattgtagtcatccttgatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 9937 - DNA, 347 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatatttctcactctttcttctgttcttgctgtaactgcaagttgtagcattgtctcactattgtagtcatccttgcattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 9938 - DNA, 265 bp, Artificial
  TaSBEIIa allele with mutations introduced by TALEN pair TaSBEIIa_T03
gagagatagctggattaggcgatcgcctcaggccctggtgttaccacggctttgatcatctcctcctttcatgctgatattttctcactctttcttctgttcttgctgtaactgcaagttgtagcattattcacttaccaaatatcggatgaaccaagccgcggaggcatcaggtttcaagcttcttctatcagcattgtgcactacttcactgccttgtgcagtttgttagctgtggccccgcgctggctcttgggccactgaa

SEQ ID NO: 9939 - DNA, 195 bp, Artificial; identical to SEQ ID NO: 9863
  TaSBEIIa allele with mutations introduced by TALEN pair TaSBEIIa_T03

SEQ ID NO: 9940 - DNA, 252 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 9941 - DNA, 424 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactga

SEQ ID NO: 9942 - DNA, 441 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccagggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 9943 - DNA, 422 bp, Artificial; identical to SEQ ID NO: 9809
  TaSBEIIa allele with mutations introduced by TALEN pair TaSBEIIa_T03

SEQ ID NO: 9944 - DNA, 202 bp, Artificial; identical to SEQ ID NO: 9791
  TaSBEIIa allele with mutations introduced by TALEN pair TaSBEIIa_T03

SEQ ID NO: 9945 - DNA, 420 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagtggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 9946 - DNA, 195 bp, Artificial; identical to SEQ ID NO: 9876
  TaSBEIIa allele with mutations introduced by TALEN pair TaSBEIIa_T03

SEQ ID NO: 9947 - DNA, 202 bp, Artificial; identical to SEQ ID NO: 9791
  TaSBEIIa allele with mutations introduced by TALEN pair TaSBEIIa_T03

SEQ ID NO: 9948 - DNA, 423 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatatttctcactctttcttctgttcttgctgtaactgcaagttgtagcattgtctcactattgtagtcatccttgcattgcaggcgccgtcctgagccgcgcgggcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggtttgagcttcttctatcagcattgtgcagtactgcactgccttgtgcattttgttagccgtggccccgtgctggctcgttgggccactgaa

SEQ ID NO: 9949 - DNA, 202 bp, Artificial; identical to SEQ ID NO: 9791
  TaSBEIIa allele with mutations introduced by TALEN pair TaSBEIIa_T03

SEQ ID NO: 9950 - DNA, 202 bp, Artificial; identical to SEQ ID NO: 9791
  TaSBEIIa allele with mutations introduced by TALEN pair TaSBEIIa_T03

SEQ ID NO: 9951 - DNA, 358 bp, Artificial
  TaSBEIIa allele with mutations introduced by TALEN pair TaSBEIIa_T03
gagagatagctggattaggcgatcgcctcaggccctggtgttaccacggctttgatcatctcctcctttcatgctgatattttctcactctttcttcctgttcttgctgtaactgcaagttgtggcgttttttcactattgtagtcatcctggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccgtggccccgtgctggctcttgggccactgaa

SEQ ID NO: 9952 - DNA, 329 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatatttctcactctttcttctgttcttgctgtaactgcaagttgtagcattgtctcactattgtagtcatcctccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggcccgtgctggctcttgggccactgaa

SEQ ID NO: 9953 - DNA, 251 bp, Artificial
  TaSBEIIa allele with mutations introduced by TALEN pair TaSBEIIa_T03
gagagatagctggattaggcgatcgcctcaggccctggtgttaccacggctttgatcatctcctcctttcatgctgatattttctcactctttcttctgttcttgctgtaactgcaagttgtagcaaatgccggatgaaaccaagccgcggaggcgtcaggttttgagcttcttctatcagcattgtgcagtactgcactgccttgtgcattttgttagccgtggcccgtgctggctcttgggccactgaa

SEQ ID NO: 9954 - DNA, 436 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgtagccgtggccccgtgctggctcgttgggccactgaa

SEQ ID NO: 9955 - DNA, 335 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 9956 - DNA, 394 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttgtagccgtggccccgtgctggctcttgggccactgaa

SEQ ID NO: 9957 - DNA, 327 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttcgtgccgggaaatcttcatacaatcgttattcacttaccaaatgccggatgaaaccaagccgcggaggcgtcaggtttgagcttcttctatcagcattgtgcagtactgcactgccttgttcattttgttagccttggccccgtgctggctcttgggccactgaa

SEQ ID NO: 9958 - DNA, 389 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 9959 - DNA, 455 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgctaggcgccgtcctgacggcgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 9960 - DNA, 263 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 9961 - DNA, 327 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcctgaagaattacaggtacacaccatcgtgccgggaaatcttcatacaatcgttattcacttaccaaatgccggatgaaaccaagccgcggaggcgtcaggtttgagcttcttctatcagcattgtgcagtactgcactgccttgtgctattttgttagccgtggccccgtgctggctcttgggccactgaa

SEQ ID NO: 9962 - DNA, 352 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 9963 - DNA, 404 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtccggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 9964 - DNA, 398 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 9965 - DNA, 406 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtccggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctgggctcttgggccacgtgaa

SEQ ID NO: 9966 - DNA, 430 bp, Artificial
  TaSBEIIa allele with mutations introduced by TALEN pair TaSBEIIa_T03
  misc_feature (425): n is a or c or t or g
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagcctttggccccgtgctggctcttgggccnctgaa

SEQ ID NO: 9967 - DNA, 384 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatatttctcactctttcttctgttcttgctgtaactgcaagttgtagcattgtctcactattgtagtcatccttgcattgcagacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 9968 - DNA, 366 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagcgacttggcaagtccggcgcaacctgaagaattacaggtacacaccatcgtgccgggaaatcttcatacaatcgttattcacttaccaaatgccggatgaaaccaagccgcggaggcgtcaggtttgagcttcttctatcagcattgtgcagtactgcactgccttgtgcatttgttagccgtggccccgtgctggctcttgggccactgaa

SEQ ID NO: 9969 - DNA, 196 bp, Artificial; identical to SEQ ID NO: 9801
  TaSBEIIa allele with mutations introduced by TALEN pair TaSBEIIa_T03

SEQ ID NO: 9970 - DNA, 195 bp, Artificial; identical to SEQ ID NO: 9805
  TaSBEIIa allele with mutations introduced by TALEN pair TaSBEIIa_T03

SEQ ID NO: 9971 - DNA, 481 bp, Artificial
  TaSBEIIa allele with mutations introduced by TALEN pair TaSBEIIa_T03
gagagatagctggattaggcgatcgcgcttcctgaacctgtatttttcccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgtagtccttcggccccgtgctggctcgttcgggcctatgaa

SEQ ID NO: 9972 - DNA, 329 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcagggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 9973 - DNA, 467 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 9974 - DNA, 318 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 9975 - DNA, 456 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccctggtgcctgacggcgagagcgacgacttggcaagtccggcgcaacctgaagaattacaggtacacacactcgtgccggtaaatcttcatacaatcgttattcacttaccaaatgccggatgaaaccaacacggatgcgtcaggtttcgagcttcttctatcagcattgtgcagtactgcactgccttgttcattttgttagccttggccccgtgctggctcttgggccactgaa

SEQ ID NO: 9976 - DNA, 403 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 9977 - DNA, 301 bp, Artificial
  TaSBEIIa allele with mutations introduced by TALEN pair TaSBEIIa_T03
gagagtagctggattaggcgatcgcctgcgtcagtgtcacccaggccctggtgttatcacggctttgatcatctcctcccattctgatattttctcactctttcttctgttcttgctgtaactgcaagttaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 9978 - DNA, 285 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatatttctcactctttcttctgttcttgctgtaactgcaagttgtatcatacaatcgttattcacttaccaaatgccggatgaaaccaagccgcggaggcgtcaggttttgagcttcttctatcagcattgtgcagtactgcactgccttgtgcattttgttagccgttggccccgtgctggctcttgggccactgaa

SEQ ID NO: 9979 - DNA, 384 bp, Artificial; identical to SEQ ID NO: 9842
  TaSBEIIa allele with mutations introduced by TALEN pair TaSBEIIa_T03

SEQ ID NO: 9980 - DNA, 202 bp, Artificial; identical to SEQ ID NO: 9791
  TaSBEIIa allele with mutations introduced by TALEN pair TaSBEIIa_T03

SEQ ID NO: 9981 - DNA, 459 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcagcttcttctatcagcattgtgcagtactgcactgccttgttcatttgttagccttggccccgtgctggctcttgggccactgaa

SEQ ID NO: 9982 - DNA, 243 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatatttctcactctttcttctgttcttaccaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 9983 - DNA, 365 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagcgacttggcaagtccggcgcaacctgaagaattacaggtacacaccatcgtgccgggaaatcttcatacaatcgttattcacttaccaaatgccggatgaaaccaagccgcggaggcgtcaggtttgagcttctctatcagcattgtgcagtactgcactgccttgtgcattttgtagccgtggccccgtgctggctcttgggccactgaa

SEQ ID NO: 9984 - DNA, 462 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagcctggtgcctgacggcgagagcgacgacttggcaagtccggcgcaacctgaagaattacaggtacacacactcgtgccggtaaatcttcatacaatcgttattcacttaccaatgccggatgaaaccaccacggatgcgtcaggtttcagcttcttctatcagcattgtgcagtactgcactgccttgttcattttgttagccttggccccgtgctggctctgggccactgaa

SEQ ID NO: 9985 - DNA, 262 bp, Artificial; identical to SEQ ID NO: 9893
  TaSBEIIa allele with mutations introduced by TALEN pair TaSBEIIa_T03

SEQ ID NO: 9986 - DNA, 334 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 9987 - DNA, 330 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatcaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 9988 - DNA, 455 bp, Artificial
  TaSBEIIa allele with mutations introduced by TALEN pair TaSBEIIa_T03
gagagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcattttgcaggcgccgtcctgagccgcgcggcctctccagtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 9989 - DNA, 416 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatatttctcactctttcttctgttcttgctgtaactgcaagttgtagcattgtctcactattgtagtcatccttgcattgcaggcgccgtcctgagccgcgcggcggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttgttagccgtggccccgtgctggctcttgggccactgaa

SEQ ID NO: 9990 - DNA, 471 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggtggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttctctatcagcattgtgcagtactgcactgccttgttcattttgttagccttggccccgtgctggctcttgggccactgaa

SEQ ID NO: 9991 - DNA, 196 bp, Artificial; identical to SEQ ID NO: 9801
  TaSBEIIa allele with mutations introduced by TALEN pair TaSBEIIa_T03

SEQ ID NO: 9992 - DNA, 263 bp, Artificial; identical to SEQ ID NO: 9960
  TaSBEIIa allele with mutations introduced by TALEN pair TaSBEIIa_T03

SEQ ID NO: 9993 - DNA, 474 bp, Artificial
  TaSBEIIa allele with mutations introduced by TALEN pair TaSBEIIa_T03
gagagatagctggattaggcgatcgcgcttcctgaacctgtatttttcccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgtgcattttgttagccgtggccccgtgctggctcttgggccacctgaa

SEQ ID NO: 9994 - DNA, 476 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 9995 - DNA, 456 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccccggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttctctatcagcattgtgcagtactgcactgccttgttcattttgttagccttggccccgtgctggctcttgggccactgaa

SEQ ID NO: 9996 - DNA, 300 bp, Artificial
  TaSBEIIa allele with mutations introduced by TALEN pair TaSBEIIa_T03
gagagtagctggattaggcgatcgcctgcgtcagtgtcacccaggccctggtgttatcacggctttgatcatctcctcccattctgatatttctcactctttcttctgttcttgctgtaactgcaagttaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 9997 - DNA, 265 bp, Artificial; identical to SEQ ID NO: 9938
  TaSBEIIa allele with mutations introduced by TALEN pair TaSBEIIa_T03

SEQ ID NO: 9998 - DNA, 253 bp, Artificial
  TaSBEIIa allele with mutations introduced by TALEN pair TaSBEIIa_T03
gagagatagctggattaggcgatcgcctcaggccctggtgttaccacggctttgatcatctcctcctttcatgctgatattttctcactctttcttctgttcttgctgtaactgcaagtcacttaccaaatatcggatgaaccaagccgcggaggcatcaggtttcaagcttcttctatcagcattgtgcactacttcactgccttgtgcagtttgttagccttggccccgtgctggctcttgggccactgaa

SEQ ID NO: 9999 - DNA, 466 bp, Artificial
  TaSBEIIa allele with mutations introduced by TALEN pair TaSBEIIa_T03
gagagatagctggattaggcgatcgcgcttcctgaacctgtatttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagctcttctatcagcattgtgcagtactgcactgccttgttcattttgttagccttggccccgtgctggctcttgggccactgaa

SEQ ID NO: 10000 - DNA, 351 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgcttggcaagtccggcgcaacctgaagaattacaggtacacaccatcgtgccgggaaatcttcatacaatcgttattcacttaccaaatgccggatgaaaccaagccgcggaggcgtcaggtttgagcttcttctatcagcattgtgcagtactgcactgccttgtgctattttgttagccgtggccccgtgctggctcttgggccactgaa

SEQ ID NO: 10001 - DNA, 434 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggtttgagcttcttctatcagcattgtgcagtactgcactgccttgtgcattttgttagccgtggccccgtgctggctcttgggccactgaa

SEQ ID NO: 10002 - DNA, 199 bp, Artificial; identical to SEQ ID NO: 9811
  TaSBEIIa allele with mutations introduced by TALEN pair TaSBEIIa_T03

SEQ ID NO: 10003 - DNA, 434 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccagggcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10004 - DNA, 265 bp, Artificial; identical to SEQ ID NO: 9938
  TaSBEIIa allele with mutations introduced by TALEN pair TaSBEIIa_T03

SEQ ID NO: 10005 - DNA, 262 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctccattctgatatttctcactctttcttctgttcttgctgtaactgcaagttgtagcattgtctcactattgtagtcatccgcggaggcgtcaggttttgagcttcttctatcagcattgtgcagtactgcactgccttgtgcatttgttagccgtggccccgtgctggctcttgggccactgaa

SEQ ID NO: 10006 - DNA, 419 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggacggtgagagcgacgacttggcaagtccggcgcaacctgaagaattacaggtacacaccatcgtgccgggaaatcttcatacaatcgttattcacttaccaatgccggatgaaaccaagccgcggaggcgtcaggttttgagcttcttctatcagcattgtgcagtactgcactgccttgtgctattttgttagccgtggccccgtgctggctcttgggccactgaa

SEQ ID NO: 10007 - DNA, 328 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatcctccatcgtgccgggaatcttcatacaatcgttattcacttaccaaatgccggatgaaaccaagccgcggaggcgtcaggtttgagcttcttctatcagcattgtgcagtactgcactgccttgtgcattttgtagccgtggccccgtgctggctcttgggccactgaa

SEQ ID NO: 10008 - DNA, 474 bp, Artificial
  TaSBEIIa allele with mutations introduced by TALEN pair TaSBEIIa_T03
gagagatagctggattaggcgatcgcgcttcctgaacctgtattttttcccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10009 - DNA, 465 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 10010 - DNA, 322 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatatttctcactctttcttctgttcttgctgtaactgcaagttgtagcattgtctcactattgtagtcatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 10011 - DNA, 474 bp, Artificial; identical to SEQ ID NO: 9013
  TaSBEIIa allele with mutations introduced by TALEN pair TaSBEIIa_T03

SEQ ID NO: 10012 - DNA, 270 bp, Artificial
  TaSBEIIa allele with mutations introduced by TALEN pair TaSBEIIa_T03
gagagatagctggattaggcgatcgcctcaggccctggtgttaccacggctttgatcattcctcgtttcattctgatatatattttctcactcttttcttcctgttcttgctgtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10013 - DNA, 196 bp, Artificial; identical to SEQ ID NO: 9801
  TaSBEIIa allele with mutations introduced by TALEN pair TaSBEIIa_T03

SEQ ID NO: 10014 - DNA, 389 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10015 - DNA, 202 bp, Artificial; identical to SEQ ID NO: 9791
  TaSBEIIa allele with mutations introduced by TALEN pair TaSBEIIa_T03

SEQ ID NO: 10016 - DNA, 348 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctgcaagtccggcgcaacctgaagaattacaggtacacaccatcgtgccgggaaatcttcatacaatcgttattcacttaccaaatgccggatgaaaccaagccgcggaggcgtcaggtttgagcttcttctatcagcattgtgcagtactgcactgccttgtgcattttgtagccgtggccccgtgctggctcttgggccactgaa

SEQ ID NO: 10017 - DNA, 442 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccagggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10018 - DNA, 325 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatatttctcactctttcttctgttcttgctgtaactgcaagttgtagcctgaagaattacaggtacacaccatcgtgccgggaaatcttcatacaatcgttattcacttaccaaatgccggatgaaaccaagccgcggaggcgtcaggtttgagcttcttctatcagcattgtgcagtactgcactgccttgtgcattttgttagccgtggccccgtgctggctcttgggccactgaa

SEQ ID NO: 10019 - DNA, 315 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtccacaccatcgtgccgggaaatcttcatacaatcgttattcacttaccaaatgccggatgaaaccaagccgcggaggcgtcaggtttgagcttcttctatcagcattgtgcagtactgcactgccttgtgcattttgttagccgtggccccgtgctggctcttgggccactgaa

SEQ ID NO: 10020 - DNA, 423 bp, Artificial
  TaSBEIIa allele with mutations introduced by TALEN pair TaSBEIIa_T03
gagagatagctggattaggcgatcgcctcaggccctggtgttaccacggctttgatcatctcctcctttcatgctgatattttctcactctttcttctgttcttgctgtaactgcaagttgtagcattttttggcaaataagttgtagcattgtctcagtattgtactcatccttgcatttgtcaggcgccgtcctgagccgcgcggccacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10021 - DNA, 385 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 10022 - DNA, 431 bp, Artificial
  TaSBEIIa allele with mutations introduced by TALEN pair TaSBEIIa_T03
  misc_feature (410): n is a or c or t or g
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgggaaggtcctggtgcctgacggtgagagcgacgacttggcaagtccggcgcaacctgaagaattacaggtacacaccatcgtgccgggaaatcgttcatacaatcgttattcacttaccaaatatcggatgaaccaagccgcggaggcatcaggtttcaagcttctctatcagcattgtgcactacttcactgccttgtgcagtttgttagctgtggccccgngctggctcttgggccactgaa

SEQ ID NO: 10023 - DNA, 441 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctggggaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctctgggccactgaa

SEQ ID NO: 10024 - DNA, 407 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcgttcttctatcagcattgtgcagtactgcactgccttgtgcattttgttagccgtggccccgtgctggctcttgggccactgaa

SEQ ID NO: 10025 - DNA, 470 bp, Artificial
  TaSBEIIa allele with mutations introduced by TALEN pair TaSBEIIa_T03
  misc_feature (449): n is a or c or t or g
gagagatagctggattaggcgatcgcgcttcctgaacctgtatttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggctggtgcctgacggcgagagcgacgacttggcaagtccggcgcaacctgaagaattacaggtacacacactcgtgccggtaaatcttcatacaatcgttattcacttaccaaatgccggatgaaaccacacggatgcgtcaggtttcgagcttcttctatcagcattgtgcagtactgcactgccttgtgcagtttgttagctgtggccccgngctggctcttgggccactgaa

SEQ ID NO: 10026 - DNA, 196 bp, Artificial; identical to SEQ ID NO: 9801
  TaSBEIIa allele with mutations introduced by TALEN pair TaSBEIIa_T03

SEQ ID NO: 10027 - DNA, 247 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcatacaatcgttattcacttaccaaatgccggatgaaaccaagccgcggaggcgtcaggttttgagcttcttctatcagcattgtgcagtactgcactgccttgtgcattttgttagccgttggccccgtgctggctcttgggccactgaa

SEQ ID NO: 10028 - DNA, 388 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 10029 - DNA, 251 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggcccgtgctggctcttgggccactgaa

SEQ ID NO: 10030 - DNA, 450 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttctctatcagcattgtgcagtactgcactgccttgttcattttgttagccttggccccgtgctggctcttgggccactgaa

SEQ ID NO: 10031 - DNA, 336 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtaagtccggcgcaacctgaagaattacaggtacacaccatcgtgccgggaaatcttcatacaatcgttattcacttaccaaatgccggatgaaaccaagccgcggaggcgtcaggtttgagcttcttctatcagcattgtgcagtactgcactgccttgtgcattttgtagccgtggccccgtgctggctcttgggccactgaa

SEQ ID NO: 10032 - DNA, 484 bp, Artificial
  TaSBEIIa allele with mutations introduced by TALEN pair TaSBEIIa_T03
agagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10033 - DNA, 449 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10034 - DNA, 373 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgttggccccgtgctggctcttgggccactgaa

SEQ ID NO: 10035 - DNA, 273 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatatttctcactctttcttctgttcttgctgtaactgcaagttgtagcattgtctcaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10036 - DNA, 473 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 10037 - DNA, 463 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactga

SEQ ID NO: 10038 - DNA, 457 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttctctatcagcattgtgcagtactgcactgccttgttcattttgttagccttggccccgtgctggctcttgggccactgaa

SEQ ID NO: 10039 - DNA, 302 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactaccttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10040 - DNA, 323 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgcatacaatcgttattcacttaccaaatgccggatgaaaccaagccgcggaggcgtcaggtttgagcttcttctatcagcattgtgcagtactgcactgccttgtgcattttgttagccgtggccccgtgctggctcttgggccactgaa

SEQ ID NO: 10041 - DNA, 378 bp, Artificial; identical to SEQ ID NO: 9931
  TaSBEIIa allele with mutations introduced by TALEN pair TaSBEIIa_T03

SEQ ID NO: 10042 - DNA, 464 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcctgacggcgagagcgacgacttggcaagtccggcgcaacctgaagaattacaggtacacacactcgtgccggtaaatcttcatacaatcgttattcacttaccaatgccggatgaaaccaaccacggatgcgtcaggtttcgagctttcttctatcagcattgtgcagtactgcactgccttgttcattttgttagccttggccccgtgctggctcttgggccactgaa

SEQ ID NO: 10043 - DNA, 446 bp, Artificial
  TaSBEIIa allele with mutations introduced by TALEN pair TaSBEIIa_T03
gagagatagctggattaggcgatcgcgcttcctgaacctgtatttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 10044 - DNA, 422 bp, Artificial
  TaSBEIIa allele with mutations introduced by TALEN pair TaSBEIIa_T03
gagagatagctggattaggcgatcgcctgcgtcagtgtcacccaggccctggtgttaccacggctttgatcattcctcgtttcattctgatatatattttctcactctttttcttcctgttcttgctgtaactgcaagttgtggtcgttttttcactattgtagtcatccttgcattttgcaggcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10045 - DNA, 327 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatatttctcactctttcttctgttcttgctgtaactgcaagttgtagcattgtctcactattgtagtcatccttgcattgcaggcaaatcttcatacaatcgttattcacttaccaaatgccggatgaaaccaagccgcggaggcgtcaggttttgagcttcttctatcagcattgtgcagtactgcactgccttgtgcattttgtagccgtggcccgtgctggctcttgggccactgaa

SEQ ID NO: 10046 - DNA, 382 bp, Artificial
  TaSBEIIa allele with mutations introduced by TALEN pair TaSBEIIa_T03
gagagatagctggattaggcgatcgcgcttcctgaacctgtatttttcccgcggggaaatgcgttagtgtcacccaggccctggtgttaccacggctttgatcattcctcgtttcattctgatatatattttctcactctttttcttcctgttcttgctgtaactgcaagttgttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10047 - DNA, 279 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtccgcgtcaggttttgagcttcttctatcagcattgtgcagtactgcactgccttgtgcattttgttagccgtggccccgtgctggctcttgggccactgaa

SEQ ID NO: 10048 - DNA, 300 bp, Artificial
  TaSBEIIa allele with mutations introduced by TALEN pair TaSBEIIa_T03
gagagtagctggattaggcgatcgcctgcgtcagtgtcacccaggccctggtgttatcacggctttgatcatctcctcccattctgatattttctcactctttcttctgttcttgctgtaactgcaagttaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 10049 - DNA, 202 bp, Artificial; identical to SEQ ID NO: 9791
  TaSBEIIa allele with mutations introduced by TALEN pair TaSBEIIa_T03

SEQ ID NO: 10050 - DNA, 337 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatatttctcactctttcttctgttcttgctgtaactgcaagttgtagcattgtctcactattgtagtcatccttgcattgcaggcgtgccgggaaatcttcatacaatcgttattcacttaccaaatgccggatgaaaccaagccgcggaggcgtcaggtttgagcttcttctatcagcattgtgcagtactgcactgccttgtgctattttgttagccgtggccccgtgctggctcttgggccactgaa

SEQ ID NO: 10051 - DNA, 479 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10052 - DNA, 378 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatatttctcactctttcttctgttcttgctgtaactgcaagttgtagcattgtctcactattgtagtcatccttgcattgcaggcgccaagtccggcgcaacctgaagaattacaggtacacaccatcgtgccggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 10053 - DNA, 428 bp, Artificial
  TaSBEIIa allele with mutations introduced by TALEN pair TaSBEIIa_T03
gagagatagctggattaggcgatcgcctcaggccctggtgttaccacggctttgatcatctcctcctttcatgctgatattttctcactctttcttctgttcttgctgtaactgcaagttgtagcattgtctcactattgtagtcatccttgcattgcaggcgccgtcctgagccgcgcgggggaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggcccccgtgctggctcttgggccactgaa

SEQ ID NO: 10054 - DNA, 473 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10055 - DNA, 202 bp, Artificial; identical to SEQ ID NO: 9791
  TaSBEIIa allele with mutations introduced by TALEN pair TaSBEIIa_T03

SEQ ID NO: 10056 - DNA, 331 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatcctccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10057 - DNA, 485 bp, Artificial
  TaSBEIIa allele with mutations introduced by TALEN pair TaSBEIIa_T03
gagagatagctggattaggcgatcgcgcttcctgaacctgtattttttcccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10058 - DNA, 391 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 10059 - DNA, 422 bp, Artificial; identical to SEQ ID NO: 8831
  TaSBEIIa allele with mutations introduced by TALEN pair TaSBEIIa_T03

SEQ ID NO: 10060 - DNA, 296 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatatttctcactctttcttctgttcttgctgtaactgcaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10061 - DNA, 418 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagctgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10062 - DNA, 486 bp, Artificial; identical to SEQ ID NO: 8818
  TaSBEIIa allele with mutations introduced by TALEN pair TaSBEIIa_T03

SEQ ID NO: 10063 - DNA, 320 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcaccatcgtgccgggaaatcttcatacaatcgttattcacttaccaaatgccgatgaaccagccgcggagcgtcaggtttgagcttcttctatcagcattgtgcagtactgcactgccttgtgcattttgtagccgtggcccgtgctggctcttgggccactgaa

SEQ ID NO: 10064 - DNA, 392 bp, Artificial
  TaSBEIIa allele with mutations introduced by TALEN pair TaSBEIIa_T03
gagagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggccactccagcgcaacctgaagaattacaggtacacacactcgtgccggtaaatcttcatacaatcgttattcacttaccaaatgccggatgaaaccaaccacggatgcgtcaggttttcgagcttcttctatcagcattgtgcagtactgcactgccttgttcatttgttagccttggccccgtgctggctcttgggccactgaa

SEQ ID NO: 10065 - DNA, 195 bp, Artificial; identical to SEQ ID NO: 9876
  TaSBEIIa allele with mutations introduced by TALEN pair TaSBEIIa_T03

SEQ ID NO: 10066 - DNA, 387 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgttggccccgtgctggctcttgggccactgaa

SEQ ID NO: 10067 - DNA, 263 bp, Artificial; identical to SEQ ID NO: 9960
  TaSBEIIa allele with mutations introduced by TALEN pair TaSBEIIa_T03

SEQ ID NO: 10068 - DNA, 327 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcagggaaatcttcatacaatcgttattcacttaccaaatgccggatgaaaccaagccgcggaggcgtcaggttttgagcttcttctatcagcattgtgcagtactgcactgccttgtgcattttgtagccgtggcccgtgctggctcttgggccatgaa

SEQ ID NO: 10069 - DNA, 312 bp, Artificial
  TaSBEIIa allele with mutations introduced by TALEN pair TaSBEIIa_T03
gagagatagctggattaggcgatcgcctcaggccctggtgttaccacggctttgatcatctcctcccattctgatattttctcactctttcttctgttcttgctgtaactgcaagttgtagcattgtctcactaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10070 - DNA, 409 bp, Artificial
  TaSBEIIa allele with mutations introduced by TALEN pair TaSBEIIa_T03
gagagatagctggattaggcgatcgcctcaggccctggtgttaccacggctttgatcatctcctcctttcatgctgatattttctcactctttcttctgttcttgctgtaactgcaagttgtagcattgtctcactattgtagtcatccttgcattgcaggcgccgtcctgagccgtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10071 - DNA, 396 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattggtctcactattgtagtcatcctggtgcctgacggtgagagcgacgacttggcaagtccggcgcaacctgaagaattacaggtacacgacactcgtgccggtaaatcttcatacaatcgttattcacttaccaaatgccggatgaaaccaaccacggatgcgtcaggtttcgagcttcttctatcagcattgtgcagtactgcactgccttgttcatttgttagccttggccccgtgctggctcttgggccactgaa

SEQ ID NO: 10072 - DNA, 329 bp, Artificial; identical to SEQ ID NO: 9816
  TaSBEIIa allele with mutations introduced by TALEN pair TaSBEIIa_T03

SEQ ID NO: 10073 - DNA, 446 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10074 - DNA, 199 bp, Artificial; identical to SEQ ID NO: 9811
  TaSBEIIa allele with mutations introduced by TALEN pair TaSBEIIa_T03

SEQ ID NO: 10075 - DNA, 196 bp, Artificial; identical to SEQ ID NO: 9801
  TaSBEIIa allele with mutations introduced by TALEN pair TaSBEIIa_T03

SEQ ID NO: 10076 - DNA, 469 bp, Artificial
  TaSBEIIa allele with mutations introduced by TALEN pair TaSBEIIa_T03
gagagatagctggattaggcgatcgcgcttcctgaacctgtattttttcccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttctctatcagcattgtgcagtactgcactgccttgttcattttgttagccttggccccgtgctggctcttcgggccactgaa

SEQ ID NO: 10077 - DNA, 198 bp, Artificial
  TaSBEIIa allele with mutations introduced by TALEN pair TaSBEIIa_T03
gagagatagctggattaggcgatcgcctcaccgtcgtgccggaaatcttcatgcacccgttattcacttaccaaatatcggatgaaccaagccgcggaggcatcaggtttcaagcttcttctatcagcattgtgcactacttcactgccttgtgcagtttgttagctgtggccccgtgctggctcttgggccactgaa

SEQ ID NO: 10078 - DNA, 395 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgttcattttgttagccttggccccgtgcctggctcttgggccactgaa

SEQ ID NO: 10079 - DNA, 202 bp, Artificial; identical to SEQ ID NO: 9791
  TaSBEIIa allele with mutations introduced by TALEN pair TaSBEIIa_T03

SEQ ID NO: 10080 - DNA, 412 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10081 - DNA, 467 bp, Artificial; identical to SEQ ID NO: 9077
  TaSBEIIa allele with mutations introduced by TALEN pair TaSBEIIa_T03

SEQ ID NO: 10082 - DNA, 442 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccagggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggtttgagcttcttctatcagcattgtgcagtactgcactgccttgtgctattttgtagccgtggccccgtgctggctcgttgggccatcgaa

SEQ ID NO: 10083 - DNA, 411 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctatttgttagccgtggccccgtgctggctcttgggccactgaa

SEQ ID NO: 10084 - DNA, 418 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatatttctcactctttcttctgttcttgctgtaactgcaagttgtagcattgtctcactattgtagtcatccttgcattgcaggcgccgtcctgagcctgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10085 - DNA, 431 bp, Artificial
  TaSBEIIa allele with mutations introduced by TALEN pair TaSBEIIa_T03
gagagatagctggattaggcgatcgcgcttcctgaacctgtattttttcccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcatttgttagccttggccccgtgctggctcttgggccactgaa

SEQ ID NO: 10086 - DNA, 328 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcaaatcttcatacaatcgttattcacttaccaaatgccggatgaaaccaagccgcggaggcgtcaggtttgagcttcttctatcagcattgtgcagtactgcactgccttgtgcattttgtagccgtggccccgtgctggctcttgggccactgaa

SEQ ID NO: 10087 - DNA, 317 bp, Artificial
  TaSBEIIa allele with mutations introduced by TALEN pair TaSBEIIa_T03
gagagatagctggattaggcgatcgcgcttcctgaacctgtatttttccccgcgggaaatgcgttagtgtcacccaggccctggtgttaccacggctttgatcattcctcgtttcattctgatatatattttctcactctttttcttcctgttcttgctgtaactgcaagttgtagcattgtctcaccaaatgccggatgaaaccaagccgcggaggcgtcaggttttgagcttcttctatcagcattgtgcagtactgcactgccttgtgcattttgttagccgttggccccgttgctggctcttgggccactgaa

SEQ ID NO: 10088 - DNA, 480 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggccggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgcctggctcttgggccactgaa

SEQ ID NO: 10089 - DNA, 305 bp, Artificial
  TaSBEIIa allele with mutations introduced by TALEN pair TaSBEIIa_T03
gagagatagctggattaggtgatcgcctgcgtcagtgtcacccaggccctggtgttatcacggctttgatcatctcctcccattctgatattttctcactctttcttctgttcttgctgtaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10090 - DNA, 395 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10091 - DNA, 427 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcgctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctctgggccactgaa

SEQ ID NO: 10092 - DNA, 473 bp, Artificial; identical to SEQ ID NO: 10054
  TaSBEIIa allele with mutations introduced by TALEN pair TaSBEIIa_T03

SEQ ID NO: 10093 - DNA, 364 bp, Artificial
  TaSBEIIa allele with mutations introduced by TALEN pair TaSBEIIa_T03
gagagatagctggattaggcgatcgcctcaggccctggtgttaccacggctttgatcattcctcgtttcattctgatatatattttctcactctttttcttcctgttcttgctgtaactgcaagttgtggcgttttttcactattgtagtcatccttgcattttgcaggacaacctgaagaattacaggtacacacactcgtgccggtaaatcttcatacaatcgttattcacttaccaaatgccggatgaaaccaaccacggatgcgtcaggttttgagcttcttctatcagcattgtgcagtactgcactgccttgtgcattttgttagccgtggccccgtgctggctcttgggccactgaa

SEQ ID NO: 10094 - DNA, 389 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10095 - DNA, 196 bp, Artificial; identical to SEQ ID NO: 9801
  TaSBEIIa allele with mutations introduced by TALEN pair TaSBEIIa_T03

SEQ ID NO: 10096 - DNA, 438 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgcgagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttctctatcagcattgtgcagtactgcactgccttgttcattttgttagccttggccccgtgctggctcttgggccactgaa

SEQ ID NO: 10097 - DNA, 378 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10098 - DNA, 335 bp, Artificial
  TaSBEIIa allele with mutations introduced by TALEN pair TaSBEIIa_T03
gagagatagctggattaggcgatcgcctgcgtcagtgtcacccaggccctggtgttaccacggctttgatcattcctcgtttcattctgatatatattttctcactctttttcttcctgttcttgctgtaactgcaagttgtggcgttttttcactattgtagtcacactcgtgccggtaaatcttcatacaatcgttattcacttaccaaatgccggatgaaaccaaccacggatgcgtcaggtttcgagcttcttctatcagcattgtgcagtactgcactgccttgtgcattttgttagccgtggccccgtgctggctcttgggccactgaa

SEQ ID NO: 10099 - DNA, 415 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10100 - DNA, 386 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcgcaacctgaagaattacaggtacacaccatcgtgccgggaaatcttcatacaatcgttattcacttaccaaatgccggatgaaaccaagccgcggaggcgtcaggttttgagtcttcttctatcagcattgtgcagtactgcactgccttgtgcattttgtagccgtggccccgtgctggctcttgggccactgaa

SEQ ID NO: 10101 - DNA, 263 bp, Artificial; identical to SEQ ID NO: 9960
  TaSBEIIa allele with mutations introduced by TALEN pair TaSBEIIa_T03

SEQ ID NO: 10102 - DNA, 454 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10103 - DNA, 427 bp, Artificial
  TaSBEIIa allele with mutations introduced by TALEN pair TaSBEIIa_T03
gagagatagctggattaggcgatcgcctcaggccctggtgttaccacggctttgatcatctcctcctttcatgctgatattttctcactctttcttctgttcttgctgtaactgcaagttgtagcattgtctcactattgtagtcatccttgcattgcaggcgccgtcctgagccgcgcgggggaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10104 - DNA, 434 bp, Artificial
  TaSBEIIa allele with mutations introduced by TALEN pair TaSBEIIa_T03
gagagatagctggattagggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10105 - DNA, 241 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10106 - DNA, 406 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgttcattttgttagccttggccccgtgctggctcttgggccactgaa

SEQ ID NO: 10107 - DNA, 421 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatatttctcactctttcttctgttcttgctgtaactgcaagttgtagcattgtctcactattgtagtcatccttgcattgcaggcgccgtcctgagccgcgcgggcctgacggtgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcatttgttagccttggccccgtgctggctcttgggccactgaa

SEQ ID NO: 10108 - DNA, 284 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatatttctcactctttcttctgttcttgctgtaactgcaagttgtatcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10109 - DNA, 414 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattttgcaggcgccgtcctgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgcctggctcttggccactgaa

SEQ ID NO: 10110 - DNA, 431 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggcccccgtgctggctcttgggccactgaa

SEQ ID NO: 10111 - DNA, 430 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccagggtgcctgacggtgagagcgacgacttggcaagtccggcgcaacctgaagaattacaggtacacaccatcgtgccgggaatcttcatacaatcgttattcacttaccaatgccggatgaaaccaagccgcggaggcgtcaggtttgagcttcttctatcagcattgtgcagtactgcactgccttgtgcattttgtagccgtggccccgtgctggctcttgggccacga

SEQ ID NO: 10112 - DNA, 467 bp, Artificial; identical to SEQ ID NO: 9077
  TaSBEIIa allele with mutations introduced by TALEN pair TaSBEIIa_T03

SEQ ID NO: 10113 - DNA, 327 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10114 - DNA, 326 bp, Artificial
  TaSBEIIa allele with mutations introduced by TALEN pair TaSBEIIa_T03
agagatagctgattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcaaatcttcatacaatcgttattcacttaccaaatgccggatgaaaccaagccgcggaggcgtcaggtttgagcttcttctatcagcattgtgcagtactgcactgccttgtgcattttgtagccgtggccccgtgctggctcttgggccactgaa

SEQ ID NO: 10115 - DNA, 424 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggtttgagcttcttctatcagcattgtgcagtactgcactgccttgtgcattttgttagccgtggccccgtgctggctcttgggccactgaa

SEQ ID NO: 10116 - DNA, 476 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 10117 - DNA, 246 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctaatcgttattcacttaccaaatgccggatgaaaccaagccgcggaggcgtcaggtttgagcttcttctatcagcattgtgcagtactgcactgccttgtgcattttgttagccgtggccccgtgctggctcttgggccactgaa

SEQ ID NO: 10118 - DNA, 390 bp, Artificial
  TaSBEIIa allele with mutations introduced by TALEN pair TaSBEIIa_T03
gagagatagctggattaggcgatcgcctcaggccctggtgttaccacggctttgatcatctcctcctttcatgctgatattttctcactctttcttctgttcttgctgtaactgcaagttgtggcgtttttcactattgtagtcatccttgcattttgcaggcgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10119 - DNA, 195 bp, Artificial; identical to SEQ ID NO: 9876
  TaSBEIIa allele with mutations introduced by TALEN pair TaSBEIIa_T03

SEQ ID NO: 10120 - DNA, 408 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcgacgacttggcggccactccagcgcaacccgaagaattacaggtacacaccgtcgtgccggaaaatcttcatgcacccgttattcacttaccaaatatcggatgaaccaagccgcggaggcgtcaggttttgagcttcttctatcagcattgtgcagtactgcactgccttgtgctattttgtagccgtggccccgtgctggctcttgggccactgaa

SEQ ID NO: 10121 - DNA, 263 bp, Artificial; identical to SEQ ID NO: 9826
  TaSBEIIa allele with mutations introduced by TALEN pair TaSBEIIa_T03

SEQ ID NO: 10122 - DNA, 409 bp, Artificial
  TaSBEIIa allele with mutations introduced by TALEN pair TaSBEIIa_T03
gagagatagctggattagggatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcgagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10123 - DNA, 315 bp, Artificial; identical to SEQ ID NO: 10019
  TaSBEIIa allele with mutations introduced by TALEN pair TaSBEIIa_T03

SEQ ID NO: 10124 - DNA, 424 bp, Artificial
  TaSBEIIa allele with mutations introduced by TALEN pair TaSBEIIa_T03
gagagatagctggattagggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10125 - DNA, 381 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10126 - DNA, 416 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctggtgcctgacggtgagagcgacgacttggcaagtccggcgcaacctgaagaattacaggtacacaccatcgtgccgggaaatcttcatacaatcgttaattcacttaccaaatgccggatgaaaccaagccgcggaggcgtcaggtttgagcttcttctatcagcattgtgcagtactgcactgccttgtgcattttgttagccgtggccccgtgctggctcttgggccactgaa

SEQ ID NO: 10127 - DNA, 194 bp, Artificial; identical to SEQ ID NO: 9910
  TaSBEIIa allele with mutations introduced by TALEN pair TaSBEIIa_T03

SEQ ID NO: 10128 - DNA, 262 bp, Artificial; identical to SEQ ID NO: 9893
  TaSBEIIa allele with mutations introduced by TALEN pair TaSBEIIa_T03

SEQ ID NO: 10129 - DNA, 330 bp, Artificial
  TaSBEIIa allele with mutations introduced by TALEN pair TaSBEIIa_T03
gagagatagctggttaggcgatcgcctgcgtcagtgtcacccaggccctggtgttatcacggctttgatcatctcctcccattctgatattttctcactctttcttctgttcttgctgtaactgcaagttgtagcattgctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10130 - DNA, 312 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatatttctcactctttcttctgttcttggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggcccgtgctggctcttgggccactgaa

SEQ ID NO: 10131 - DNA, 449 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctctgggccactgaa

SEQ ID NO: 10132 - DNA, 280 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtccgcgtcaggttttgagcttcttctatcagcattgtgcagtactgcactgccttgtgctattttgttagccgtggccccgtgctggctcttgggccactgaa

SEQ ID NO: 10133 - DNA, 376 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgttagccgtggccccgtgctggctcttgggccactgaa

SEQ ID NO: 10134 - DNA, 460 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10135 - DNA, 369 bp, Artificial; identical to SEQ ID NO: 9849
  TaSBEIIa allele with mutations introduced by TALEN pair TaSBEIIa_T03

SEQ ID NO: 10136 - DNA, 418 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccttggccccgtgctggctcttgggccactgaa

SEQ ID NO: 10137 - DNA, 347 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 10138 - DNA, 196 bp, Artificial; identical to SEQ ID NO: 9801
  TaSBEIIa allele with mutations introduced by TALEN pair TaSBEIIa_T03

SEQ ID NO: 10139 - DNA, 306 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgttggccccgtgctggctcttgggccactgaa

SEQ ID NO: 10140 - DNA, 473 bp, Artificial; identical to SEQ ID NO: 10054
  TaSBEIIa allele with mutations introduced by TALEN pair TaSBEIIa_T03

SEQ ID NO: 10141 - DNA, 195 bp, Artificial; identical to SEQ ID NO: 9876
  TaSBEIIa allele with mutations introduced by TALEN pair TaSBEIIa_T03

SEQ ID NO: 10142 - DNA, 421 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgttggccccgtgctggctcttgggccactgaa

SEQ ID NO: 10143 - DNA, 462 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggttttcgagcttcttctatcagcattgtgcagtactgcactgccttgttcattttgttagccttggccccgtgcctggctcttgggccactgaa

SEQ ID NO: 10144 - DNA, 199 bp, Artificial; identical to SEQ ID NO: 9811
  TaSBEIIa allele with mutations introduced by TALEN pair TaSBEIIa_T03

SEQ ID NO: 10145 - DNA, 404 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcatttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaactgaactgccaaggcacacaggggatagg

SEQ ID NO: 10146 - DNA, 195 bp, Artificial; identical to SEQ ID NO: 9805
  TaSBEIIa allele with mutations introduced by TALEN pair TaSBEIIa_T03

SEQ ID NO: 10147 - DNA, 404 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10148 - DNA, 262 bp, Artificial; identical to SEQ ID NO: 9893
  TaSBEIIa allele with mutations introduced by TALEN pair TaSBEIIa_T03

SEQ ID NO: 10149 - DNA, 195 bp, Artificial; identical to SEQ ID NO: 9805
  TaSBEIIa allele with mutations introduced by TALEN pair TaSBEIIa_T03

SEQ ID NO: 10150 - DNA, 402 bp, Artificial
  TaSBEIIa allele with mutations introduced by TALEN pair TaSBEIIa_T03
gagagatagctggattaggcgatcgcctcaggccctggtgttaccacggctttgatcatctcctcctttcatgctgatattttctcactctttcttctgttcttgctgtaactgcaagttgtagcattgtctcactattgtagtcatccttgcattttgcaggcgccgtcctgagccgcggagagcgacgacttggcaagtccggcgcaacctgaagaattacaggtacacacactcgtgccggtaaatcttcatacaatcgttattcacttaccaaatgccggatgaaaccaaccacggatgcgtcaggttttcgagcttcttctatcagcattgtgcagtactgcactgccttgttcattttgttagccttggccccgtgctggctcttgggccactgaa

SEQ ID NO: 10151 - DNA, 486 bp, Artificial; identical to SEQ ID NO: 8818
  TaSBEIIa allele with mutations introduced by TALEN pair TaSBEIIa_T03

SEQ ID NO: 10152 - DNA, 330 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgttagccgtggcccgtgctggctcttgggccactgaa

SEQ ID NO: 10153 - DNA, 433 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagtctgtggccccgtcgctggctcttgggccacgaa

SEQ ID NO: 10154 - DNA, 453 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 10155 - DNA, 330 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatcaccatcgtgccgggaaatcttcatacaatcgttattcacttaccaaatgccggatgaaaccaagccgcggaggcgtcaggttttgagcttcttctatcagcattgtgcagtactgcactgccttgttcattttgttagccttggccccgtgctggctcttgggccactgaa

SEQ ID NO: 10156 - DNA, 421 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 10157 - DNA, 455 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcggagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10158 - DNA, 462 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcccctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10159 - DNA, 195 bp, Artificial; identical to SEQ ID NO: 9876
  TaSBEIIa allele with mutations introduced by TALEN pair TaSBEIIa_T03

SEQ ID NO: 10160 - DNA, 416 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtccggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggcccccgtgctggctcttgggccactgaa

SEQ ID NO: 10161 - DNA, 475 bp, Artificial
  TaSBEIIa allele with mutations introduced by TALEN pair TaSBEIIa_T03
gagagatagctggattaggcgatcgcgcttcctgaacctgtattttttcccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggtcctggtgcctgacggcgagagcgacgacttggcaagtccggcgcaacctgaagaattacaggtaccacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10162 - DNA, 474 bp, Artificial
  TaSBEIIa allele with mutations introduced by TALEN pair TaSBEIIa_T03
gagagatagctggattaggcgatcgcgcttcctgaacctgtattttttcccgcggggaaatgcgttagtgtcacccaggccctggtgttaccacggctttgatcattcctcgtttcattctgatatatattttctcactctttttcttcctgttcttgctgtaactgcaagttgtggtcgttttttcactattgtagtcatccttgcattttgcaggcgccgtcctgagccgcgcggcctgtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagtccttggccccgtgctggctcttgggccactgaa

SEQ ID NO: 10163 - DNA, 264 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatatttctcactctttcttctgttcttgctgtaactgcaagttgtagcattgtctcactattgtagtcatccgcggaggcgtcaggttttgagcttcttctatcagcattgtgcagtactgcactgccttgtgcattttgttagccgtggccccgtgctggctcttgggccactgaa

SEQ ID NO: 10164 - DNA, 300 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatatttctcactctttcttctgttcttgctgtaactgcaagttgtagcattgtctcactaccttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 10165 - DNA, 327 bp, Artificial
  TaSBEIIa allele with mutations introduced by TALEN pair TaSBEIIa_T03
gagagatagctggattagggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttcgtgccgggaaatcttcatacaatcgttattcacttaccaaatgccggatgaaaccaagccgcggaggcgtcaggtttgagcttcttctatcagcattgtgcagtactgcactgccttgtgcattttgtagccgtggccccgtgctggctcttgggccactgaa

SEQ ID NO: 10166 - DNA, 467 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgcctggctcttgggccactgaa

SEQ ID NO: 10167 - DNA, 262 bp, Artificial
  TaSBEIIa allele with mutations introduced by TALEN pair TaSBEIIa_T03
gagagatagctggattaggcgatcgcctcaggccctggtgttaccacggctttgatcatctcctcctttcatgctgatattttctcactctttcttctgttcttgctgtaactgcaagttgcgttattcacttaccaaatatcggatgaaccaagccgcggaggcatcaggtttcgagcttcttctatcagcattgtgcagtactgcactgccttgttcattttgttagcctttggcccgtgctggctcttgggccactgaa

SEQ ID NO: 10168 - DNA, 301 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgccgggaaatcttcatacaatcgttattcacttaccaaatgccggatgaaaccaagccgcggaggcgtcaggttttgagcttcttctatcagcattgtgcagtactgcactgccttgtgctatttgttagccgtggcccgtgctggctcttgggccactgaa

SEQ ID NO: 10169 - DNA, 422 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagcctggtgcctgacggtgagagcgacgacttgggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 10170 - DNA, 442 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10171 - DNA, 477 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10172 - DNA, 245 bp, Artificial
  TaSBEIIa allele with mutations introduced by TALEN pair TaSBEIIa_T03
gagagatagctggattaggcgatcgcctgcgtcagtgtcaccaggccctggtgttatcacggctttgatcatctcctcccattctgatattttctcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10173 - DNA, 201 bp, Artificial
  TaSBEIIa allele with mutations introduced by TALEN pair TaSBEIIa_T03
gagagatagctggattaggcgatcgcctgcgtcagtgtcacccaggccctttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10174 - DNA, 391 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgttagccgtggccccgtgctggctcgttgggccactgaa

SEQ ID NO: 10175 - DNA, 402 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagagcgacgacttggcaagtccggcgcaacctgaagaattacaggtacacaccatcgtgccgggaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10176 - DNA, 290 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgtgtgccgggaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10177 - DNA, 426 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgccctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcatttgttagccttggccccgtgctggctcttgggccactgaa

SEQ ID NO: 10178 - DNA, 202 bp, Artificial; identical to SEQ ID NO: 9791
  TaSBEIIa allele with mutations introduced by TALEN pair TaSBEIIa_T03

SEQ ID NO: 10179 - DNA, 431 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggccctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10180 - DNA, 402 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgtagccttggccccgtgctggctcttgggccactgaa

SEQ ID NO: 10181 - DNA, 202 bp, Artificial; identical to SEQ ID NO: 9791
  TaSBEIIa allele with mutations introduced by TALEN pair TaSBEIIa_T03

SEQ ID NO: 10182 - DNA, 430 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10183 - DNA, 472 bp, Artificial
  TaSBEIIa allele with mutations introduced by TALEN pair TaSBEIIa_T03
gagagatagctggattaggcgatcgcgcttcctgaacttgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctggtgcctgacggcgagagcgacgacttggcaagtccggcgcaacctgaagaattacaggtacacacactcgtgccggtaaatcttcatacaatcgttattcacttaccaaatgccggatgaaaaccaaccacggatgcgtcaggtttcgagcttcttctatcagcattgtgcagtactgcactgccttgttcattttgttagccttggccccgtgctggctcttgggccact

SEQ ID NO: 10184 - DNA, 322 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatcgtgccgggaaatcttcatacaatcgttattcacttaccaaatgccggatgaaaccaagccgcggaggcgtcaggtttgagcttcttctatcagcattgtgcagtactgcactgccttgtgcattttgtagccgtggccccgtgctggctcttgggccactgaa

SEQ ID NO: 10185 - DNA, 263 bp, Artificial; identical to SEQ ID NO: 9883
  TaSBEIIa allele with mutations introduced by TALEN pair TaSBEIIa_T03

SEQ ID NO: 10186 - DNA, 480 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcgggaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10187 - DNA, 297 bp, Artificial
  TaSBEIIa allele with mutations introduced by TALEN pair TaSBEIIa_T03
gagagatagctggattaggcgatcgcctcaggccctggtgttaccacggctttgatcatctcctcctttcatgctgatattttctcactctttcttctgttcttgctgtaactgcaagttgtggcgttttttcactattgtaaatcttcatacaatcgttattcacttaccaaatgccggatgaaaccaaccacggatgcgtcaggtttcgagcttcttctatcagcattgtgcagtactgcactgccttgtgcattttgttagccgtggccccgtgctggctcttgggccactgaa

SEQ ID NO: 10188 - DNA, 323 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatcgtgccgggaaatcttcatacaatcgttattcacttaccaaatgccggatgaaaccaagccgcggaggcgtcaggtttgagcttcttctatcagcattgtgcagtactgcactgccttgtgcattttgttagccgtggccccgtgctggctcttgggccactgaa

SEQ ID NO: 10189 - DNA, 415 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10190 - DNA, 264 bp, Artificial; identical to SEQ ID NO: 10163
  TaSBEIIa allele with mutations introduced by TALEN pair TaSBEIIa_T03

SEQ ID NO: 10191 - DNA, 415 bp, Artificial; identical to SEQ ID NO: 10189
  TaSBEIIa allele with mutations introduced by TALEN pair TaSBEIIa_T03

SEQ ID NO: 10192 - DNA, 442 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcggcgagagcgacgacttggcaagtccggcgcaacctgaagaattacaggtacacacactcgtgccggtaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 10193 - DNA, 464 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagtggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10194 - DNA, 196 bp, Artificial; identical to SEQ ID NO: 9801
  TaSBEIIa allele with mutations introduced by TALEN pair TaSBEIIa_T03

SEQ ID NO: 10195 - DNA, 455 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcgagcgacgacttggcaagtccggcgcaacctgaagaattacaggtacacacactcgtgcccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10196 - DNA, 377 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 10197 - DNA, 425 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcgcctgacggtgagagcgacgacttggcaagtccggcgcaacctgaagaattacaggtacacaccatcgtgccgggaaatcttcatacaatcgttattcacttaccaaatgccggatgaaaccaaccacggatgcgtcaggtttcgagcttcttctatcagcattgtgcagtactgcactgccttgttcattttgttagtccttggccccgtgctggctcttgggccactgaa

SEQ ID NO: 10198 - DNA, 252 bp, Artificial; identical to SEQ ID NO: 9940
  TaSBEIIa allele with mutations introduced by TALEN pair TaSBEIIa_T03

SEQ ID NO: 10199 - DNA, 355 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtccggcgcaacctgaagaattacaggtacacaccatcgtgccgggaaatcttcatacaatcgttattcacttaccaaatgccggatgaaaccaagccgcggaggcgtcaggtttgagcttcttctatcagcattgtgcagtactgcactgccttgtgcattttgttagccgtggccccgtgctggctcttgggccactgaa

SEQ ID NO: 10200 - DNA, 424 bp, Artificial
  TaSBEIIa allele with mutations introduced by TALEN pair TaSBEIIa_T03
agagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtccctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggtttcgagcttcttctatcagcattgtgcagtactgcactgccttgttcattttgttagccttggccccgtgctggctcttgggccactgaa

SEQ ID NO: 10201 - DNA, 417 bp, Artificial
  TaSBEIIa allele with mutations introduced by TALEN pair TaSBEIIa_T03
gagagatagctggattaggcgatcgcctcaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10202 - DNA, 307 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgttagccgtggccccgtgctggctcgttgggccactgaa

SEQ ID NO: 10203 - DNA, 371 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactga

SEQ ID NO: 10204 - DNA, 195 bp, Artificial; identical to SEQ ID NO: 9876
  TaSBEIIa allele with mutations introduced by TALEN pair TaSBEIIa_T03

SEQ ID NO: 10205 - DNA, 402 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttggggccactgaa

SEQ ID NO: 10206 - DNA, 470 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 10207 - DNA, 226 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcattccttcatacaatcgttattcacttaccaaatgccggatgaaaccaaccacggatgcgtcaggtttcgagcttcttctatcagcattgtgcagtactgcactgccttgttcattttgttagccttggcccgtgctggctcttgggccactgaa

SEQ ID NO: 10208 - DNA, 268 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccgcggaggcgtcaggttttgagtcttcttctatcagcattgtgcagtactgcactgccttgtgctattttgttagccgtggccccgtgctggctcgttgggccactgaa

SEQ ID NO: 10209 - DNA, 278 bp, Artificial
  TaSBEIIa allele with mutations introduced by TALEN pair TaSBEIIa_T03
gagagatagctggattaggcgatcgcctcaggccctggtgttaccacggctttgatcatctcctcctttcatgctgatattttctcactctttcttctgttcttgctgtaactgcaagttgtagcattgtctcactcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10210 - DNA, 476 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgggaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10211 - DNA, 376 bp, Artificial; identical to SEQ ID NO: 9870
  TaSBEIIa allele with mutations introduced by TALEN pair TaSBEIIa_T03

SEQ ID NO: 10212 - DNA, 378 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccaagtccggcgcaacctgaagaattacaggtacacaccatcgtgccggaaatcttcatacaatcgttattcacttaccaaatgccggatgaaaccaagccgcggaggcgtcaggttttgagcttcttctatcagcattgtgcagtactgcactgccttgtgcatttgtagccgtggccccgtgctggctcttgggccactgaa

SEQ ID NO: 10213 - DNA, 480 bp, Artificial; identical to SEQ ID NO: 10186
  TaSBEIIa allele with mutations introduced by TALEN pair TaSBEIIa_T03

SEQ ID NO: 10214 - DNA, 301 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatatttctcactctttcttctgttcttgctgtaactgcaagttaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10215 - DNA, 417 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggtttgagcttcttctatcagcattgtgcagtactgcactgccttgtgcattttgttagccgttggccccgtgctgggctcttgggccactgaa

SEQ ID NO: 10216 - DNA, 366 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcaagtccggcgcaacctgaagaattacaggtacacaccatcgtgccgggaaatcttcatacaatcgttattcacttaccaaatgccggatgaaaccaaccacggatgcgtcaggttcgagcttcttctatcagcattgtgcagtactgcactgccttgttcattttgtagccttggccccgtgctggctcttgggccactgaa

SEQ ID NO: 10217 - DNA, 369 bp, Artificial; identical to SEQ ID NO: 9849
  TaSBEIIa allele with mutations introduced by TALEN pair TaSBEIIa_T03

SEQ ID NO: 10218 - DNA, 465 bp, Artificial
  TaSBEIIa allele with mutations introduced by TALEN pair TaSBEIIa_T03
gagagatagctggattaggcgatcgcgcttcctgaacctgtatttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10219 - DNA, 431 bp, Artificial
  TaSBEIIa allele with mutations introduced by TALEN pair TaSBEIIa_T03
gagagatagctggattaggcgatcgcgcttcctgaacctgtatttttcccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10220 - DNA, 336 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtaagtccggcgcaacctgaagaattacaggtacacaccatcgtgccgggaaatcttcatacaatcgttattcacttaccaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 10221 - DNA, 430 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattttgcaggcgccgtcctgagccgcgcgcctggtgcctgacggcgagagcgacgacttggcaagtccggcgcaacctgaagaattacaggtacacacactcgtgccggtaaatcttcatacaatcgttatcacttaccaaatgccggatgaaaccaaccacggatgcgtcaggtttcgagcttcttctatcagcattgtgcagtactgcactgccttgttcattttgttagtccttggccccgtgctggctcttgggccactgaa

SEQ ID NO: 10222 - DNA, 457 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcgcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggtcccgtgctggctcttgggccactgaa

SEQ ID NO: 10223 - DNA, 478 bp, Artificial; identical to SEQ ID NO: 8889
  TaSBEIIa allele with mutations introduced by TALEN pair TaSBEIIa_T03

SEQ ID NO: 10224 - DNA, 330 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgctgaagaattacaggtacacaccatcgtgccgggaaatcttcatacaatcgttattcacttaccaaatgccggatgaaaccaagccgcggaggcgtcaggtttgagcttcttctatcagcattgtgcagtactgcactgccttgtgcattttgttagccgtggccccgtgctggctcttgggccactgaa

SEQ ID NO: 10225 - DNA, 196 bp, Artificial; identical to SEQ ID NO: 9801
  TaSBEIIa allele with mutations introduced by TALEN pair TaSBEIIa_T03

SEQ ID NO: 10226 - DNA, 422 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10227 - DNA, 195 bp, Artificial; identical to SEQ ID NO: 9876
  TaSBEIIa allele with mutations introduced by TALEN pair TaSBEIIa_T03

SEQ ID NO: 10228 - DNA, 409 bp, Artificial
  TaSBEIIa allele with mutations introduced by TALEN pair TaSBEIIa_T03
gagagatagctgttaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10229 - DNA, 430 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgtagccgtggccccgtgctggctcttgggccactgaa

SEQ ID NO: 10230 - DNA, 195 bp, Artificial; identical to SEQ ID NO: 9876
  TaSBEIIa allele with mutations introduced by TALEN pair TaSBEIIa_T03

SEQ ID NO: 10231 - DNA, 365 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcacggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgtagccgtggccccgtgctggctcttgggccactgaa

SEQ ID NO: 10232 - DNA, 394 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgtgccggtaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctctgggccactgaa

SEQ ID NO: 10233 - DNA, 441 bp, Artificial; identical to SEQ ID NO: 9942
  TaSBEIIa allele with mutations introduced by TALEN pair TaSBEIIa_T03

SEQ ID NO: 10234 - DNA, 417 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagctgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 10235 - DNA, 330 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcagggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10236 - DNA, 287 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatatttctcactctttcttctgttcttgctgtaactgcaagttgtagcattgtctcactcgttattcacttaccaaatgccggatgaaaccaagccgcggaggcgtcaggttttgagcttcttctatcagcattgtgcagtactgcactgccttgtgcatttgttagccgtggccccgtgctggctcttgggccactgaa

SEQ ID NO: 10237 - DNA, 472 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggtggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10238 - DNA, 287 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatatttctcactctttcttctgttcttgctgtaactgcaagttgtagcattgtctcactcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 10239 - DNA, 447 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10240 - DNA, 471 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggctggtgcctgacggcgagagcgacgacttggcaagtccggcgcaacctgaagaattacaggtacacacactcgtgccggtaaatcttcatacaatcgttattcacttaccaaatgccggatgaaaccacacggatgcgtcaggtttcgagcttcttctatcagcattgtgcagtactgcactgccttgttcattttgttagccttggccccgtgctggctcttgggccactgaa

SEQ ID NO: 10241 - DNA, 380 bp, Artificial
  TaSBEIIa allele with mutations introduced by TALEN pair TaSBEIIa_T03
  misc_feature (359): n is a or c or t or g
gagagatagctggattggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgcggccactccagcgcaacccgaagaattacaggtacacaccgtcgtgccggaaaaatcttcatgcacccgttattcacttaccaaatatcggatgaaccaagccgcggaggcatcaggtttcaagcttcttctatcagcattgtgcactacttcactgccttgtgcagtttgttagctgtgcccgngctgctcgtggacctactgaa

SEQ ID NO: 10242 - DNA, 424 bp, Artificial
  TaSBEIIa allele with mutations introduced by TALEN pair TaSBEIIa_T03
  misc_feature (401): n is a or c or t or g
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagcctggtgcctgacggtgagagcgacgacttggcaagtccggcgcaacctgaagaattacaggtacacaccatcgtgccggaaaatcttacatgcacccgttattcacttaccaaatatcggatgaaccaagccgcggaggcatcaggtttcaagcttcttctatcagcattgtgcactacttcactgccttgtgcagtttgttagctgtggccccgngctggctcgttgggccacgtgaa

SEQ ID NO: 10243 - DNA, 384 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcagacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccatgaa

SEQ ID NO: 10244 - DNA, 323 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgaattacaggtacacaccatcgtgccgggaaatcttcatacaatcgttattcacttaccaatgccggatgaaaccaagccgcggaggcgtcaggtttgagcttcttctatcagcattgtgcagtactgcactgccttgtgcattttgttagccgtggccccgtgctggctcttgggccactgaa

SEQ ID NO: 10245 - DNA, 434 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 10246 - DNA, 415 bp, Artificial
  TaSBEIIa allele with mutations introduced by TALEN pair TaSBEIIa_T03
  misc_feature (410): n is a or c or t or g
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggcccccgtgctggctcttgggccnctgaa

SEQ ID NO: 10247 - DNA, 238 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattaaatcttcatacaatcgttattcacttaccaaatgccggatgaaaccaagccgcggaggcgtcaggtttgagcttcttctatcagcattgtgcagtactgcactgccttgtgcattttgtagccgtggcccgtgctggctcttgggccactgaa

SEQ ID NO: 10248 - DNA, 459 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10249 - DNA, 389 bp, Artificial
  TaSBEIIa allele with mutations introduced by TALEN pair TaSBEIIa_T03
gagagatagctggattaggcgatcgcctcaggccctggtgttaccacggctttgatcattcctcgtttcattctgatatatattttctcactctttttcttcctgttcttgctgtaactgcaagttgtggcgttttttcactattgtagtcatccttgcattttgcaggcgcgagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgtcattttgtagccttggccccgtgctggctcttgggccactgaa

SEQ ID NO: 10250 - DNA, 347 bp, Artificial; identical to SEQ ID NO: 10137
  TaSBEIIa allele with mutations introduced by TALEN pair TaSBEIIa_T03

SEQ ID NO: 10251 - DNA, 472 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctgtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 10252 - DNA, 403 bp, Artificial
  TaSBEIIa allele with mutations introduced by TALEN pair TaSBEIIa_T03
  misc_feature (390): n is a or c or t or g
gagagatagctggattaggcgatcgcctgcgtcagtgtcacccaggccctggtgttatcacggctttgatcatctcctcccattctgatatttctcactctttcttctgttcttgctgtaactgcaagttgtagcattgtctcactattgtagtcatccttgcattgcaggcgccgtcctgagccgcgcggcgacttggcaagtccggcgcaacctgaagaattacaggtacacaccatcgtgccgggaaatcttcatacaatcgttattcacttaccaatgccggatgaaaccaagccgcggaggcgtcaggttttgagcttcttctatcagcattgtgcagtactgcactgccttgtgcatttgttagccgtggccccgtgctggctnttgggccactgaa

SEQ ID NO: 10253 - DNA, 403 bp, Artificial
  TaSBEIIa allele with mutations introduced by TALEN pair TaSBEIIa_T03
gagagatagctggattaggcgatcgcctgcgtcagtgtcacccaggtcctggtgttatcacggctttgatcatctcctcccattctgatattttctcactctttcttctgttcttgctgtaactgcaagttgtagcattgtctcactattgtagtcatccttgcattgctgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgcccttgtgcattttgttagccgtggccccgtgctggctcttgggccactgaa

SEQ ID NO: 10254 - DNA, 396 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttggtgcctgacggtgagagcgacgacttggcaagtccggcgcaacctgaagaattacaggtacacaccatcgtgccgggaaatcttcatacaatcgttattcacttaccaaatgccggatgaaaccaagccgacggaggcgtcaggttttgagcttcttctatcagcattgtgcagtactgcactgccttgtgcattttgtagccgtggccccgtgctggctcttgggccatgaa

SEQ ID NO: 10255 - DNA, 471 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcgcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgtagccttggccccgtgctggctcttgggccactgaa

SEQ ID NO: 10256 - DNA, 451 bp, Artificial
  TaSBEIIa allele with mutations introduced by TALEN pair TaSBEIIa_T03
  misc_feature (280): n is a or c or t or g
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgtgcctgacggcgagagcgacgacttggcaagtccggcgcaacctgaagaattacaggtacncacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10257 - DNA, 254 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgcatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggcccgtgctggctcttgggccactgaa

SEQ ID NO: 10258 - DNA, 486 bp, Artificial; identical to SEQ ID NO: 8818
  TaSBEIIa allele with mutations introduced by TALEN pair TaSBEIIa_T03

SEQ ID NO: 10259 - DNA, 457 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10260 - DNA, 292 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactacaatcgttattcacttaccaaatgccggatgaaaccaagccgcggaggcgtcaggttttgagcttcttctatcagcattgtgcagtactgcactgccttgtgctattttgtagccgtggcccgtgctggctcttgggccactga

SEQ ID NO: 10261 - DNA, 450 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcatctcctcccattctgatattttctcactctttcttctgttcttgctgtaactgcaagttgtagcattgtctcactattgtagtcatccttgcattgcaggcgccgtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10262 - DNA, 470 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcgggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10263 - DNA, 407 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcatggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10264 - DNA, 294 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10265 - DNA, 195 bp, Artificial
  TaSBEIIa allele with mutations introduced by TALEN pair TaSBEIIa_T03
gagagatagctggattaggcgatcgccatcgtgccgggaaatcttcatacaatcgttattcacttaccaaatgccggatgaaaccaagccgcggaggcgtcaggttttgagcttcttctatcagcattgtgcagtactgcactgccttgttcattttgttagccttggccccgtgctggctcttgggccactgaa

SEQ ID NO: 10266 - DNA, 285 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtatcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10267 - DNA, 195 bp, Artificial; identical to SEQ ID NO: 9876
  TaSBEIIa allele with mutations introduced by TALEN pair TaSBEIIa_T03

SEQ ID NO: 10268 - DNA, 415 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcgttgggccactgaa

SEQ ID NO: 10269 - DNA, 330 bp, Artificial
  TaSBEIIa allele with mutations introduced by TALEN pair TaSBEIIa_T03
gagagatagctggataggcgatcgcctgcgtcagtgtcacccaggccctggtgttatcacggctttgatcatctcctcccattctgatattttctcactctttcttctgttcttgctgtaactgcaagttgtagcattgtctcactattgtagtcatcctccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10270 - DNA, 331 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttccatcgtgccgggaaatcttcatacaatcgttatcacttaccaaatgccggatgaaaccaagccgcggaggcgtcaggtttgagcttcttctatcagcattgtgcagtactgcactgccttgtgcattttgttagccgttggccccgtgctggctcttgggccactgaa

SEQ ID NO: 10271 - DNA, 458 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgtagccttggccccgtgctggctcttgggccactgaa

SEQ ID NO: 10272 - DNA, 420 bp, Artificial; identical to SEQ ID NO: 9945
  TaSBEIIa allele with mutations introduced by TALEN pair TaSBEIIa_T03

SEQ ID NO: 10273 - DNA, 468 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10274 - DNA, 461 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagctgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgtagccttggccccgtgctggctcttgggccactgaa

SEQ ID NO: 10275 - DNA, 242 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatatttctcactctaatcgttattcacttaccaatgccggatgaaaccaagccgcggaggcgtcaggtttgagcttcttctatcagcattgtgcagtactgcactgccttgtgcattttgtagccgtggcccgtgctggctcttgggccactgaa

SEQ ID NO: 10276 - DNA, 446 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 10277 - DNA, 437 bp, Artificial
  TaSBEIIa allele with mutations introduced by TALEN pair TaSBEIIa_T03
gagagatagctggattaggcgatcgcgcttcctgaacctgtatttttccccgcggggaaatgcgttagtgtcacccaggccctggtgttaccacggctttgatacattcctcgtttcattctgatatatattttctcactctttttcttcctgttcttgctgtaactgcaagttgtggcgttttttcactattgtagtcatccttgcattttgcaggcgagcgacgacttggcaagtccggcgcaacctgaagaattacaggtacacacactcgtgccggtaaatcttcatacaatcgttattcacttaccaaatgccggatgaaaccaaccacggatgcgtcaggttttcgagcttcttctatcagcattgtgcagtactgcactgccttgttcatttgttagccttggccccgtgctggctcttgggccactgaa

SEQ ID NO: 10278 - DNA, 467 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgaggtcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 10279 - DNA, 376 bp, Artificial
  TaSBEIIa allele with mutations introduced by TALEN pair TaSBEIIa_T03
gagagatagctggattggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgttagccgtggccccgtgctggctcttgggccactgaa

SEQ ID NO: 10280 - DNA, 423 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10281 - DNA, 385 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcagacgacttggcaagtccggcgcaacctgaagaattacaggtacacaccatcgtgccggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcgttgggccactgaa

SEQ ID NO: 10282 - DNA, 451 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10283 - DNA, 430 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10284 - DNA, 446 bp, Artificial
  TaSBEIIa allele with mutations introduced by TALEN pair TaSBEIIa_T03
  misc_feature (381): n is a or c or t or g
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgngcagtactgcactgccttgttcattttgttagccttggccccgtgctggctcttgggccactgaa

SEQ ID NO: 10285 - DNA, 453 bp, Artificial; identical to SEQ ID NO: 10154
  TaSBEIIa allele with mutations introduced by TALEN pair TaSBEIIa_T03

SEQ ID NO: 10286 - DNA, 473 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggcccccgtgctggctcttgggccactgaa

SEQ ID NO: 10287 - DNA, 196 bp, Artificial; identical to SEQ ID NO: 9801
  TaSBEIIa allele with mutations introduced by TALEN pair TaSBEIIa_T03

SEQ ID NO: 10288 - DNA, 386 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcagacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10289 - DNA, 313 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactctgaagaattacaggtacacaccatcgtgccgggaaatcttcatacaatcgttattcacttaccaaatgccggatgaaaccaagccgcggaggcgtcaggtttgagcttcttctatcagcattgtgcagtactgcactgccttgtgcattttgtagccgtggccccgtgctggctcttgggccactgaa

SEQ ID NO: 10290 - DNA, 196 bp, Artificial; identical to SEQ ID NO: 9801
  TaSBEIIa allele with mutations introduced by TALEN pair TaSBEIIa_T03

SEQ ID NO: 10291 - DNA, 486 bp, Artificial; identical to SEQ ID NO: 8887
  TaSBEIIa allele with mutations introduced by TALEN pair TaSBEIIa_T03

SEQ ID NO: 10292 - DNA, 379 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgtagccgtggccccgtgctggctcgttgggccactgaa

SEQ ID NO: 10293 - DNA, 246 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatatttctcactctaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10294 - DNA, 430 bp, Artificial; identical to SEQ ID NO: 10182
  TaSBEIIa allele with mutations introduced by TALEN pair TaSBEIIa_T03

SEQ ID NO: 10295 - DNA, 397 bp, Artificial
  TaSBEIIa allele with mutations introduced by TALEN pair TaSBEIIa_T03
  misc_feature (352): n is a or c or t or g
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgngcattttgtagccgtggccccgtgctggctcgttgggccactgaa

SEQ ID NO: 10296 - DNA, 467 bp, Artificial; identical to SEQ ID NO: 9077
  TaSBEIIa allele with mutations introduced by TALEN pair TaSBEIIa_T03

SEQ ID NO: 10297 - DNA, 458 bp, Artificial
  TaSBEIIa allele with mutations introduced by TALEN pair TaSBEIIa_T03
gagagatagctggattaggcgatcgcgcttcctgaacctgtattttttcccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 10298 - DNA, 469 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgtagtccttggccccgtgctggctcttgggccactgaa

SEQ ID NO: 10299 - DNA, 445 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10300 - DNA, 413 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgctggtgcctgacggtgagagcgacgacttggcaagtccggcgcaacctgaagaattacaggtacacaccatcgtgccgggaaatcttcatacaatcgtattcacttaccaaatgccggatgaaaccaagccgcggaggcgtcaggttttgagcttcttctatcagcattgtgcagtactgcactgccttgttcattttgttagccttggccccgtgctggctcttgggccactgaa

SEQ ID NO: 10301 - DNA, 378 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10302 - DNA, 479 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcgggaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgtcattttgttagccttggccccgtgctggctcttgggccactgaa

SEQ ID NO: 10303 - DNA, 326 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcaccatcgtgccgggaaatcttcatacaatcgttattcacttaccaaatgccggatgaaaccaagccgcggaggcgtcaggtttgagcttcttctatcagcattgtgcagtactgcactgccttgtgcattttgttagccgtggccccgtgctggctcttgggccactgaa

SEQ ID NO: 10304 - DNA, 386 bp, Artificial; identical to SEQ ID NO: 10288
  TaSBEIIa allele with mutations introduced by TALEN pair TaSBEIIa_T03

SEQ ID NO: 10305 - DNA, 475 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10306 - DNA, 411 bp, Artificial
  TaSBEIIa allele with mutations introduced by TALEN pair TaSBEIIa_T03
  misc_feature (391): n is a or c or t or g
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagcggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgngctggctcttgggccatgaa

SEQ ID NO: 10307 - DNA, 479 bp, Artificial
  TaSBEIIa allele with mutations introduced by TALEN pair TaSBEIIa_T03
gagagatagctggattaggcgatcgcgcttcctgaacctgtattttttcccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagccttggccccgtgctggctcttgggccactgaa

SEQ ID NO: 10308 - DNA, 367 bp, Artificial
  TaSBEIIa allele with mutations introduced by TALEN pair TaSBEIIa_T03
gagagatagctggattaggcgatcgcctcaggccctggtgttaccacggctttgatcattcctcgtttcattctgatatatattttctcactcttttcttcctgttcttgctgtaactgcaagttgtggcgtttttcactattgtagtcatccttgcatttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgtagccttggccccgtgctggctcttgggccactgaa

SEQ ID NO: 10309 - DNA, 479 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggagcctgacggcgagagcgacgacttggcaagtccggcgcaacctgaagaattacaggtacacacactcgtgccggtaaatcttcatacaatcgttattcacttaccaaatgccggatgaaaccacacggatgcgtcaggtttcgagcttcttctatcagcattgtgcagtactgcactgccttgttctattttgttagccttggccccgtgctggctcttgggccactgaa

SEQ ID NO: 10310 - DNA, 411 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagcggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgtagccgtggccccgtgctggctcgttgggccactgaa

SEQ ID NO: 10311 - DNA, 284 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtatcatacaatcgttattcacttaccaaatgccggatgaaaccaagccgcggaggcgtcaggttttgagcttctctatcagcattgtgcagtactgcactgccttgtgcattttgttagccgtggccccgtgctggctcttgggccactgaa

SEQ ID NO: 10312 - DNA, 406 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtccggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgtagccgtggccccgtgctggctcgttgggccactgaa

SEQ ID NO: 10313 - DNA, 390 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcgttgggccactgaa

SEQ ID NO: 10314 - DNA, 455 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10315 - DNA, 380 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggtggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 10316 - DNA, 370 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgtagccgtggccccgtgctggctcttgggccactgaa

SEQ ID NO: 10317 - DNA, 430 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10318 - DNA, 430 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggccctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 10319 - DNA, 395 bp, Artificial; identical to SEQ ID NO: 10090
  TaSBEIIa allele with mutations introduced by TALEN pair TaSBEIIa_T03

SEQ ID NO: 10320 - DNA, 428 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcgctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10321 - DNA, 252 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10322 - DNA, 441 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10323 - DNA, 484 bp, Artificial
  TaSBEIIa allele with mutations introduced by TALEN pair TaSBEIIa_T03
gagagatagctggattaggcgatcgcgcttcctgaacctgttattttttccccgcggggaaatgcgttagtgtcacccaggccctggtgttaccacggctttgatcattcctcgtttcattctgatatatattttctcactctttttcttcctgttcttgctgtaactgcaagttgtggtcgttttttcactattgtagtcatccttgcattttgcaggcgccgtcctgagccgcgcggcctcgtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagtccttggccccgtgctggctcgttgggccactgaa

SEQ ID NO: 10324 - DNA, 405 bp, Artificial
  TaSBEIIa allele with mutations introduced by TALEN pair TaSBEIIa_T03
  misc_feature (361): n is a or c or t or g
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgngcattttgtagccgtggccccgtgctggctcttgggccactgaa

SEQ ID NO: 10325 - DNA, 251 bp, Artificial
  TaSBEIIa allele with mutations introduced by TALEN pair TaSBEIIa_T03
gagagatagctggattaggcgatcgcctgcgtcagtgtcactcaggccctggtgttatcacggctttgatcatctcctcccaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 10326 - DNA, 374 bp, Artificial
  TaSBEIIa allele with mutations introduced by TALEN pair TaSBEIIa_T03
gagagatagctggattaggcgatcgcctcaggccctggtgttaccacggctttgatcattcctcgtttcattctgatatatattttctcactcttttcttcctgttcttgctgtaactgcaagttgtggcgttttttcactattgtaacggcgagagcgacgacttggcaagtccggcgcaacctgaagaattacaggtacacacactcgtgccggtaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10327 - DNA, 473 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgaaggtcctggtgcctgacggcgagagcgacgacttggcaagtccggcgcaacctgaagattacaggtacacacactcgtgccggtaaatcttcatacaatcgttattcacttaccaaatgccggatgaaaccaaccacggatgcgtcaggtttcgagcttctctatcagcattgtgcagtactgcactgccttgttcattttgtagccttggccccgtgctggctcttgggccactgaa

SEQ ID NO: 10328 - DNA, 473 bp, Artificial; identical to SEQ ID NO: 10054
  TaSBEIIa allele with mutations introduced by TALEN pair TaSBEIIa_T03

SEQ ID NO: 10329 - DNA, 380 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggcccgtgctggctctgggccactgaa

SEQ ID NO: 10330 - DNA, 472 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggcggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10331 - DNA, 245 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10332 - DNA, 399 bp, Artificial
  TaSBEIIa allele with mutations introduced by TALEN pair TaSBEIIa_T03
gagagatagctggattaggcgatcgcctgcgtcagtgtcacccaggccctggtgttaccacggctttgatcattcctcgtttcattctgatatatattttctcactcttttcttcctgttcttgctgtaactgcaagttgtggcgttttttcactattgtagtcatccttgcatttggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgtagccttggccccgtgctggctcttgggccactgaa

SEQ ID NO: 10333 - DNA, 478 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgtagccttggccccgtgctggctcttgggccactgaa

SEQ ID NO: 10334 - DNA, 436 bp, Artificial
  TaSBEIIa allele with mutations introduced by TALEN pair TaSBEIIa_T03
gagagatagctgggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctcctggtgcctgacggtgagagcgacgacttggcaagtccggcgcaacctgaagaattacaggtacacaccatcgtgccgggaaatcttcatacaatcgttattcacttaccaaatgccggatgaaaccaaccacggatgcgtcaggtttcgagcttcttctatcagcattgtgcagtactgcactgcctttgttcattttgttagccttggccccgtgctggctcttgggccactgaa

SEQ ID NO: 10335 - DNA, 284 bp, Artificial
  TaSBEIIa allele with mutations introduced by TALEN pair TaSBEIIa_T03
gagagatagctggattaggcgatcgcctgcgtcagtgtcacccaggccctggtgttaccacggctttgatcattcctcgtttcattctgatatatattttctcactctttttcttcctgttcttgctgtaactgcaagttgtggcgttttcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10336 - DNA, 433 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcgttgggccactgaa

SEQ ID NO: 10337 - DNA, 408 bp, Artificial
  TaSBEIIa allele with mutations introduced by TALEN pair TaSBEIIa_T03
gagagatagctggattaggcgatagcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgagagcgacgacttggcaagtccggcgcaacctgaagaattacaggtacacacactcgtgccggtaaatcttcatacaatcgttattcacttaccaaatgccggatgaaaccaagccgcggaggcgtcaggttttgagcttcttctatcagcattgtgcagtactgcactgccttgtgcattttgttagccttggccccgtgctggctcttgggccactgaa

SEQ ID NO: 10338 - DNA, 458 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 10339 - DNA, 292 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatatttctcactctttcttctgttcttgctgtaactgcaagttgtagcattgtctcactacaatcgttattcacttaccaatgccggatgaaaccaagccgcggaggcgtcaggttttgagcttcttctatcagcattgtgcagtactgcactgccttgtgcattttgttagccgtggccccgtgcaggctcttgggccactgaa

SEQ ID NO: 10340 - DNA, 459 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcgcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagtccttggccccgtgctggctcttgggccactgaa

SEQ ID NO: 10341 - DNA, 320 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgcatacaatcgttatcacttaccaaatgccggatgaaaccaagccgcggaggcgtcaggtttgagcttcttctatcagcattgtgcagtactgcactgccttgtgcattttgtagccgtggcccgtgctggctcttgggccactgaa

SEQ ID NO: 10342 - DNA, 463 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactg

SEQ ID NO: 10343 - DNA, 302 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10344 - DNA, 442 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccagggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgaggcttcttctatcagcattgtgcagtactgcactgccttgtgcattttgtagccgtggccccgtgctggctcttgggccactgaa

SEQ ID NO: 10345 - DNA, 245 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 10346 - DNA, 480 bp, Artificial; identical to SEQ ID NO: 10186
  TaSBEIIa allele with mutations introduced by TALEN pair TaSBEIIa_T03

SEQ ID NO: 10347 - DNA, 414 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggtttgagcttcttctatcagcattgtgcagtactgcactgccttgtgcattttgtagccgtggccccgtgctggctcttgggccactgaa

SEQ ID NO: 10348 - DNA, 325 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 10349 - DNA, 443 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccagggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcgttgggccactgaa

SEQ ID NO: 10350 - DNA, 436 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 10351 - DNA, 199 bp, Artificial; identical to SEQ ID NO: 9811
  TaSBEIIa allele with mutations introduced by TALEN pair TaSBEIIa_T03

SEQ ID NO: 10352 - DNA, 404 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtccggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttgttagccgtggccccgtgctggctcttgggccactgaa

SEQ ID NO: 10353 - DNA, 416 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtccctggtgcctgacggtgagagcgacgacttggcaagtccggcgcaacctgaagaattacaggtacacaccatcgtgccgggaaatcttcatacaatcgttaattcacttaccaaatgccggatgaaaccaagccgcggaggcgtcaggtttgagcttctctatcagcattgtgcagtactgcactgccttgtgcattttgttagccgtggccccgtgctggctcttgggccactgaa

SEQ ID NO: 10354 - DNA, 256 bp, Artificial
  TaSBEIIa allele with mutations introduced by TALEN pair TaSBEIIa_T03
gagagatagctggattaggcgatcgcctcaggccctggtgttaccacggctttgatcattcctcgtttcattctgatatatattttctcactctttttcttcctgttcttgctgcgttattcacttaccaaatgccggatgaaaccaaccacggatgcgtcaggtttcgagcttcttctatcagcattgtgcagtactgcactgccttgttctattttgttagccttggccccgtgctggctcttgggccactgaa

SEQ ID NO: 10355 - DNA, 404 bp, Artificial; identical to SEQ ID NO: 10147
  TaSBEIIa allele with mutations introduced by TALEN pair TaSBEIIa_T03

SEQ ID NO: 10356 - DNA, 372 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatatttctcactctttcttctgttcttgctgtaactgcaagttgtagcattgtctcactattgtagtcatccttgcattggcaagtccggcgcaacctgaagaatacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 10357 - DNA, 430 bp, Artificial; identical to SEQ ID NO: 10283
  TaSBEIIa allele with mutations introduced by TALEN pair TaSBEIIa_T03

SEQ ID NO: 10358 - DNA, 305 bp, Artificial; identical to SEQ ID NO: 9898
  TaSBEIIa allele with mutations introduced by TALEN pair TaSBEIIa_T03

SEQ ID NO: 10359 - DNA, 199 bp, Artificial; identical to SEQ ID NO: 9811
  TaSBEIIa allele with mutations introduced by TALEN pair TaSBEIIa_T03

SEQ ID NO: 10360 - DNA, 329 bp, Artificial
  TaSBEIIa allele with mutations introduced by TALEN pair TaSBEIIa_T03
gagagatagctggattaggcgatcgcctcaggccctggtgttaccacggctttgatcattcctcgtttcattctgatatatattttctcactctttttcttcctgttcttgctgtaactgcaagttgtggcgttttaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10361 - DNA, 433 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10362 - DNA, 199 bp, Artificial; identical to SEQ ID NO: 9811
  TaSBEIIa allele with mutations introduced by TALEN pair TaSBEIIa_T03

SEQ ID NO: 10363 - DNA, 472 bp, Artificial
  TaSBEIIa allele with mutations introduced by TALEN pair TaSBEIIa_T03
gagagatagctggattaggcgatcgcgcttcctgaacctgtattttttcccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagctcttctatcagcattgtgcagtactgcactgccttgttcattttgttagccttggccccgtgctggctcttgggccactgaa

SEQ ID NO: 10364 - DNA, 431 bp, Artificial; identical to SEQ ID NO: 10179
  TaSBEIIa allele with mutations introduced by TALEN pair TaSBEIIa_T03

SEQ ID NO: 10365 - DNA, 463 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttctctatcagcattgtgcagtactgcactgccttgttcattttgttagccttggccccgtgctggctcttgggccactgaa

SEQ ID NO: 10366 - DNA, 265 bp, Artificial; identical to SEQ ID NO: 9938
  TaSBEIIa allele with mutations introduced by TALEN pair TaSBEIIa_T03

SEQ ID NO: 10367 - DNA, 404 bp, Artificial
  TaSBEIIa allele with mutations introduced by TALEN pair TaSBEIIa_T03
gagagatagctggattaggcgatcgcctcaggccctggtgttaccacggctttgatcattcctcgtttcattctgatatatattttctcactcttttcttcctgttcttgctgtaactgcaagttgtggcgtttttcactattgtagtcatccttgcattttgcaggcgccgtcctgagccgcgcgagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10368 - DNA, 468 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcgtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcgttgggccactgaa

SEQ ID NO: 10369 - DNA, 435 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10370 - DNA, 449 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggtcccgtgctggctcttgggccactgaa

SEQ ID NO: 10371 - DNA, 195 bp, Artificial; identical to SEQ ID NO: 9876
  TaSBEIIa allele with mutations introduced by TALEN pair TaSBEIIa_T03

SEQ ID NO: 10372 - DNA, 243 bp, Artificial
  TaSBEIIa allele with mutations introduced by TALEN pair TaSBEIIa_T03
gagagatagctggattaggcgatcgcctcaggccctggtgttaccacggctttgatcatctcctcccattctgcatcgtgccgggaaatcttcatacaatcgttattcacttaccaaatgccggatgaaaccaagccgcggaggcatcaggtttcaagcttcttctatcagcattgtgcactacttcactgccttgtgcagtttgttagctgtcggccccgcgctggctcttgggccactgaa

SEQ ID NO: 10373 - DNA, 446 bp, Artificial
  TaSBEIIa allele with mutations introduced by TALEN pair TaSBEIIa_T03
gagagatagctggattaggcgatcgcgcttcctgaacctgtatttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10374 - DNA, 262 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcaaatgccggatgaaaccaagccgcggaggcgtcaggttttgagcttcttctatcagcattgtgcagtactgcactgccttgtgctatttgttagccgtggcccgtgctggctcttgggccactgaa

SEQ ID NO: 10375 - DNA, 379 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10376 - DNA, 264 bp, Artificial; identical to SEQ ID NO: 10163
  TaSBEIIa allele with mutations introduced by TALEN pair TaSBEIIa_T03

SEQ ID NO: 10377 - DNA, 402 bp, Artificial
  TaSBEIIa allele with mutations introduced by TALEN pair TaSBEIIa_T03
gagagatagctggattaggcgatcgcctcaggccctggtgttaccacggctttgatcatctcctcctttcatgctgatattttctcactctttcttctgttcttgctgtaactgcaagttgtggcgtttttcactattgtagtcatccttgcattttgcaggcgccgtcctgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10378 - DNA, 481 bp, Artificial
  TaSBEIIa allele with mutations introduced by TALEN pair TaSBEIIa_T03
gaggatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggggaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgcctggctcttgggccactgaa

SEQ ID NO: 10379 - DNA, 444 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccagggtcctggtgcctgacggtgagagcgacgacttggcaagtccggcgcaacctgaagaattacaggtacacaccatcgtgccgggaaatcttcatacaatcgttattcacttaccaatgccggatgaaaccaagccgcggaggcgtcaggttttgagcttcttctatcagcattgtgcagtactgcactgccttgtgctattttgttagccgttggcccccgtgctggctcttgggccactgaa

SEQ ID NO: 10380 - DNA, 434 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccagggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggtttgagcttctctatcagcattgtgcagtactgcactgccttgtgctattttgtagccgtggccccgtgctggctcttgggccactgaa

SEQ ID NO: 10381 - DNA, 473 bp, Artificial; identical to SEQ ID NO: 10036
  TaSBEIIa allele with mutations introduced by TALEN pair TaSBEIIa_T03

SEQ ID NO: 10382 - DNA, 442 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattttgcaggcgccgtcctgagccgcgcggcctctccagggcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10383 - DNA, 434 bp, Artificial
  TaSBEIIa allele with mutations introduced by TALEN pair TaSBEIIa_T03
gagagatagctggattaggcgatcgcctgcgtcagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttctctatcagcattgtgcagtactgcactgccttgttcattttgttagccttggccccgtgctggctcttgggccactgaa

SEQ ID NO: 10384 - DNA, 375 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 10385 - DNA, 417 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcgttgggccactgaa

SEQ ID NO: 10386 - DNA, 462 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagctgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10387 - DNA, 437 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10388 - DNA, 405 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgcctggctcttgggccactgaa

SEQ ID NO: 10389 - DNA, 453 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggccacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10390 - DNA, 436 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatatttctcactctttcttctgttcttgctgtaactgcaagttgtagcattgtctcactattgtagtcatccttgcattttgcaggcgccgtcctgagccgcgcggcctctcggtcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttctctatcagcattgtgcagtactgcactgccttgttcattttgtagccttggccccgtgctggctcttgggccactgaa

SEQ ID NO: 10391 - DNA, 390 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttcttctgttcttgctgtaactgcaagttgtagcattgtctgcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10392 - DNA, 409 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10393 - DNA, 474 bp, Artificial; identical to SEQ ID NO: 9013
  TaSBEIIa allele with mutations introduced by TALEN pair TaSBEIIa_T03

SEQ ID NO: 10394 - DNA, 463 bp, Artificial
  TaSBEIIa allele with mutations introduced by TALEN pair TaSBEIIa_T03
gagagatagctggattaggcgatcgcgcttcctgaacctgtattttttcccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcggcgagagcgacgacttggcaagtccggcgcaacctgaagaattacaggtacacacactcgtgccggtaaatcttcatacaatcgttattcacttaccaatgccggatgaaaccaccacggatgcgtcaggtttcagcttcttctatcagcattgtgcagtactgcactgccttgttcattttgttagccttggccccgtgctggctcttgggccactgaa

SEQ ID NO: 10395 - DNA, 367 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttcttctgttcttgctgtaactgcaagttgtagcctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgttcattttgttagccttggccccgtgctggctcttgggccactgaa

SEQ ID NO: 10396 - DNA, 324 bp, Artificial
  TaSBEIIa allele with mutations introduced by TALEN pair TaSBEIIa_T03
gagagatagctggattaggcgatcgcctcaggccctggtgttaccacggctttgatcatctcctcccattctgatattttctcactctttcttctgttcttgctgtaactgcaagttgtaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10397 - DNA, 394 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10398 - DNA, 403 bp, Artificial
  TaSBEIIa allele with mutations introduced by TALEN pair TaSBEIIa_T03
gagagatagctggattaggcgatcgcctcaggccctggtgttaccacggctttgatcatctcctcccattctgatattttctcactcttttcttctgttcttgctgtaactgcaagttgtagcattgtctcactattgtagtcatccttgcattgcaggcgccgtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10399 - DNA, 479 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10400 - DNA, 443 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctgggaaggtcctggtgcctgacggtgagagcgacgacttggcaagtccggcgcaacctgaagaattacaggtacacaccatcgtgccgggaaatcttcatacaatcgttattcacttaccaatgccggatgaaaccaagccgcggaggcgtcaggttttgagcttcttctatcagcattgtgcagtactgcactgccttgtgctattttgttagccgttggcccccgtgctggctcttgggccactgaa

SEQ ID NO: 10401 - DNA, 456 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10402 - DNA, 299 bp, Artificial
  TaSBEIIa allele with mutations introduced by TALEN pair TaSBEIIa_T03
gagagatagctggattaggcgatcgcctcaggccctggtgttaccacggctttgatcattcctcgtttcattctgatatatattttctcactctttttcttcctgttcttgctgtaactgcaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10403 - DNA, 396 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgcccttgtgctattttgttagccgtggccccgtgctggctcttggccactgaa

SEQ ID NO: 10404 - DNA, 285 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctccattctgatatttctcactctttcttctgttcttgctgtaactgtgtgccggtaatcttcatacaatcgttattcacttaccaaatgccggatgaaccaaccacggatgcgtcaggttcgagcttcttctatcagcattgtgcagtactgcactgccttgttcattttgttagccttggccccgtgctggctcttgggccactgaa

SEQ ID NO: 10405 - DNA, 316 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtccacaccatcgtgccgggaaatcttcatacaatcgttattcacttaccaaatgccggatgaaaccaagccgcggaggcgtcaggtttgagcttcttctatcagcattgtgcagtactgcactgccttgtgctattttgttagccgtggccccgtgctggctcttgggccactgaa

SEQ ID NO: 10406 - DNA, 427 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10407 - DNA, 334 bp, Artificial
  TaSBEIIa allele with mutations introduced by TALEN pair TaSBEIIa_T03
gagagatagctggattaggcgatcgcctcaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10408 - DNA, 433 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcatctcctcccattctgatattttctcactctttcttctgttcttgctgtaactgcaagttgtagcattgtctcactattgtagtcatccttgcattgcaggcgccgtcctgagccgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10409 - DNA, 380 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatatttctcactctttcttctgttcttgctgtaactgcaagttgtagcattgtctcactattgtagtcatccttgcattgcaggtggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgcctggctcttgggccactgaa

SEQ ID NO: 10410 - DNA, 448 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 10411 - DNA, 386 bp, Artificial; identical to SEQ ID NO: 10288
  TaSBEIIa allele with mutations introduced by TALEN pair TaSBEIIa_T03

SEQ ID NO: 10412 - DNA, 199 bp, Artificial; identical to SEQ ID NO: 9811
  TaSBEIIa allele with mutations introduced by TALEN pair TaSBEIIa_T03

SEQ ID NO: 10413 - DNA, 471 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgctcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagctcttctatcagcattgtgcagtactgcactgccttgttcattttgttagccttggccccgtgctggctcttgggccactgaa

SEQ ID NO: 10414 - DNA, 335 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10415 - DNA, 465 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10416 - DNA, 466 bp, Artificial
  TaSBEIIa allele with mutations introduced by TALEN pair TaSBEIIa_T03
  misc_feature (465): n is a or c or t or g
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactna

SEQ ID NO: 10417 - DNA, 424 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgttagccgtggccccgtgctggctcttgggccactgaa

SEQ ID NO: 10418 - DNA, 436 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10419 - DNA, 478 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactga

SEQ ID NO: 10420 - DNA, 467 bp, Artificial
  TaSBEIIa allele with mutations introduced by TALEN pair TaSBEIIa_T03
gagagatagctggattaggcgatcgcgcttcctgaacctgtattttttcccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcgtgcctgacggcgagagcgacgacttggcaagtccggcgcaacctgaagaattacaggtacacacactcgtgccggtaaatcttcatacaatcgttattcacttaccaatgccggatgaaaccaaccacggatgcgtcaggtttcgagcttcttctatcagcattgtgcagtactgcactcgccttgttcattttgttagccttggccccgtgctggctcttgggccactgaa

SEQ ID NO: 10421 - DNA, 454 bp, Artificial
  TaSBEIIa allele with mutations introduced by TALEN pair TaSBEIIa_T03
gagagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcattttgcaggcgccgtcctgagccgcgcggcctctccagggcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggcccctgctggctcttgggccactgaa

SEQ ID NO: 10422 - DNA, 202 bp, Artificial; identical to SEQ ID NO: 9791
  TaSBEIIa allele with mutations introduced by TALEN pair TaSBEIIa_T03

SEQ ID NO: 10423 - DNA, 466 bp, Artificial
  TaSBEIIa allele with mutations introduced by TALEN pair TaSBEIIa_T03
gagagatagctggattaggcgatcgcgcttcctgaacctgtatttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcgggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcagcttcttctatcagcattgtgcagtactgcactgccttgttcatttgttagccttggccccgtgctggctcttgggccactgaa

SEQ ID NO: 10424 - DNA, 264 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccgcggaggcgtcaggttttgagcttcttctatcagcattgtgcagtactgcactgccttgtgcattttgttagccgtggcccgtgctggctcttgggccactgaa

SEQ ID NO: 10425 - DNA, 254 bp, Artificial
  TaSBEIIa allele with mutations introduced by TALEN pair TaSBEIIa_T03
gagagatagctggattaggcgatcgcctcaggccctggtgttaccacggctttgatcatctcctcctttcatgctgatattttctcactctttcttctgttcttgctgtaactgcaagttgtagcattgtctcactattgtagtcatccgcggaggcgtcaggttttgagcttcttctatcagcattgtgcagtactgcactgccttgtgcattttgttagccgtggccccgtgctggctcttgggccactgaa

SEQ ID NO: 10426 - DNA, 478 bp, Artificial
  TaSBEIIa allele with mutations introduced by TALEN pair TaSBEIIa_T03
gagagatagctggattaggcgatcgcgcttcctgaacctgtattttttcccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctgtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10427 - DNA, 202 bp, Artificial; identical to SEQ ID NO: 9791
  TaSBEIIa allele with mutations introduced by TALEN pair TaSBEIIa_T03

SEQ ID NO: 10428 - DNA, 402 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctctttgggccactgaa

SEQ ID NO: 10429 - DNA, 305 bp, Artificial; identical to SEQ ID NO: 9898
  TaSBEIIa allele with mutations introduced by TALEN pair TaSBEIIa_T03

SEQ ID NO: 10430 - DNA, 376 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatatttctcactctttcttctgttcttgctgtaactgcaagttgtagcattgtctcactattgtagtcatccttgcattggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgtagccgtggccccgtgctggctcgttgggccacgtgaa

SEQ ID NO: 10431 - DNA, 370 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagcgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgttagccgtggccccgtgctggctcgttgggccactgaa

SEQ ID NO: 10432 - DNA, 442 bp, Artificial
  TaSBEIIa allele with mutations introduced by TALEN pair TaSBEIIa_T03
gagagatagctggattaggcgatcgcctgcgtcagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggctcccggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10433 - DNA, 473 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgccacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10434 - DNA, 466 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcgtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttctctatcagcattgtgcagtactgcactgccttgtgcattttgtagccgtggccccgtgctggctcttgggccactgaa

SEQ ID NO: 10435 - DNA, 196 bp, Artificial; identical to SEQ ID NO: 9801
  TaSBEIIa allele with mutations introduced by TALEN pair TaSBEIIa_T03

SEQ ID NO: 10436 - DNA, 196 bp, Artificial; identical to SEQ ID NO: 9801
  TaSBEIIa allele with mutations introduced by TALEN pair TaSBEIIa_T03

SEQ ID NO: 10437 - DNA, 199 bp, Artificial; identical to SEQ ID NO: 9811
  TaSBEIIa allele with mutations introduced by TALEN pair TaSBEIIa_T03

SEQ ID NO: 10438 - DNA, 445 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10439 - DNA, 413 bp, Artificial
  TaSBEIIa allele with mutations introduced by TALEN pair TaSBEIIa_T03
gagagatagctggattaggcgatcgcctcaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgcccttgttcattttgttagccttggccccgtgctggctcttgggccactgaa

SEQ ID NO: 10440 - DNA, 327 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcaacctgaagaattacaggtacacaccatcgtgccgggaaatcttcatacaatcgttattcacttaccaaatgccggatgaaaccagccgcggaggcgtcaggtttgagcttcttctatcagcattgtgcagtactgcactgccttgtgcattttgtagccgtggccccgtgctggctcttgggccactgaa

SEQ ID NO: 10441 - DNA, 479 bp, Artificial; identical to SEQ ID NO: 9018
  TaSBEIIa allele with mutations introduced by TALEN pair TaSBEIIa_T03

SEQ ID NO: 10442 - DNA, 417 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcgttgggccactgaa

SEQ ID NO: 10443 - DNA, 472 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggccctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagctcttctatcagcattgtgcagtactgcactgccttgttcattttgtagccttggccccgtgctggctcttgggccactgaa

SEQ ID NO: 10444 - DNA, 435 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10445 - DNA, 263 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcaagtccggcgcaacctgaagaattacaggtacacaccatcgtgccgggaaatcttcatacaatcgttattcacttaccaaatgccggatgaaccaagccgcggaggc

SEQ ID NO: 10446 - DNA, 435 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgacttggcaagtccggcgcaacctgaagaattacaggtacacacactcgtgccggtaaatcttcatacaatcgttattcacttaccaaatgccggatgaaaccaagccgcggaggcgtcaggttttgagtcttcttctatcagcattgtgcagtactgcactgccttgtgcattttgttagccgtggccccgtgctggctcttgggccactgaa

SEQ ID NO: 10447 - DNA, 476 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggctcccggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10448 - DNA, 470 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgctggtgcctgacggcgagagcgacgacttggcaagtccggcgcaacctgaagaattacaggtacacacactcgtgccggtaaatcttcatacaatcgttattcacttaccaaatgccggatgaaaaccaaccacggatgcgtcaggtttcgagcttcttctatcagcattgtgcagtactgcactgccttgttcattttgtagccttggccccgtgctggctcttgggccactgaa

SEQ ID NO: 10449 - DNA, 434 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggtttgagcttcttctatcagcattgtgcagtactgcactgccttgtgcattttgtagccgtggccccgtgctggctcttgggccacgtgaa

SEQ ID NO: 10450 - DNA, 384 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10451 - DNA, 414 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggtttgagcttcttctatcagcattgtgcagtactgcactgccttgtgcattttgttagccgtggccccgtgctggctcttgggccactgaa

SEQ ID NO: 10452 - DNA, 386 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcagacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgtagccgtggccccgtgctggctcttgggccactgaa

SEQ ID NO: 10453 - DNA, 380 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgttagccgtggccccgtgctggctcttgggccactgaa

SEQ ID NO: 10454 - DNA, 447 bp, Artificial
  TaSBEIIa allele with mutations introduced by TALEN pair TaSBEIIa_T03
  misc_feature (426): n is a or c or t or g
gagagatagctggattaggcgatcgcctgcgtcagtgtcacccaggccctggtgttatcacggctttgatcatctcctcccattctgatattttctcactctttcttctgttcttgctgtaactgcaagttgtagctatttttttggcaaataagttgtagcattgtctcagtattgtactcatccttgcatttgcaggcgccgtcctgaggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgngctggctcttgggccactgaa

SEQ ID NO: 10455 - DNA, 380 bp, Artificial; identical to SEQ ID NO: 10315
  TaSBEIIa allele with mutations introduced by TALEN pair TaSBEIIa_T03

SEQ ID NO: 10456 - DNA, 460 bp, Artificial; identical to SEQ ID NO: 10134
  TaSBEIIa allele with mutations introduced by TALEN pair TaSBEIIa_T03

SEQ ID NO: 10457 - DNA, 447 bp, Artificial
  TaSBEIIa allele with mutations introduced by TALEN pair TaSBEIIa_T03
gagagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10458 - DNA, 466 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcgtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcagcttcttctatcagcattgtgcagtactgcactgccttgttcattttgttagccttggccccgtgctggctcttgggccactgaa

SEQ ID NO: 10459 - DNA, 430 bp, Artificial; identical to SEQ ID NO: 10283
  TaSBEIIa allele with mutations introduced by TALEN pair TaSBEIIa_T03

SEQ ID NO: 10460 - DNA, 441 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagacttggcaagtccggcgcaacctgaagaattacaggtacacacactcgtgccgggaaatcttcatacaatcgttattcacttaccaaatgccggatgaaaccaagccgcggaggcgtcaggttttgagcttcttctatcagcattgtgcagtactgcactgccttgtgcattttgttagctgtggccccgcgctggctcttgggccactgaa

SEQ ID NO: 10461 - DNA, 474 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggccctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgtagccttggccccgtgctggctcttgggccactgaa

SEQ ID NO: 10462 - DNA, 202 bp, Artificial; identical to SEQ ID NO: 9791
  TaSBEIIa allele with mutations introduced by TALEN pair TaSBEIIa_T03

SEQ ID NO: 10463 - DNA, 467 bp, Artificial; identical to SEQ ID NO: 9077
  TaSBEIIa allele with mutations introduced by TALEN pair TaSBEIIa_T03

SEQ ID NO: 10464 - DNA, 371 bp, Artificial; identical to SEQ ID NO: 10203
  TaSBEIIa allele with mutations introduced by TALEN pair TaSBEIIa_T03

SEQ ID NO: 10465 - DNA, 403 bp, Artificial; identical to SEQ ID NO: 9976
  TaSBEIIa allele with mutations introduced by TALEN pair TaSBEIIa_T03

SEQ ID NO: 10466 - DNA, 469 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcgtgcctgacggcgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10467 - DNA, 196 bp, Artificial; identical to SEQ ID NO: 9801
  TaSBEIIa allele with mutations introduced by TALEN pair TaSBEIIa_T03

SEQ ID NO: 10468 - DNA, 484 bp, Artificial; identical to SEQ ID NO: 8985
  TaSBEIIa allele with mutations introduced by TALEN pair TaSBEIIa_T03

SEQ ID NO: 10469 - DNA, 462 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagtggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttctctatcagcattgtgcagtactgcactgccttgttcattttgttagccttggccccgtgctggctcttgggccactgaa

SEQ ID NO: 10470 - DNA, 416 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10471 - DNA, 476 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggttttgagcttcttctatcagcattgtgcagtactgcactgccttgtgcattttgttagccgtggcccccgtgctggctcttgggccactgaa

SEQ ID NO: 10472 - DNA, 262 bp, Artificial; identical to SEQ ID NO: 9893
  TaSBEIIa allele with mutations introduced by TALEN pair TaSBEIIa_T03

SEQ ID NO: 10473 - DNA, 486 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggtcctggtgcctgacggcgagagcgacgacttggaaacgtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 10474 - DNA, 396 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgttagccgtggccccgtgctggctcttgggccactgaa

SEQ ID NO: 10475 - DNA, 476 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagtccttggccccgtgctggctcttgggccactgaa

SEQ ID NO: 10476 - DNA, 379 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgtagccgtggccccgtgctggctcgttgggccactgaa

SEQ ID NO: 10477 - DNA, 366 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcatctcctcccattctgatattttctcactctttcttctgttcttgctgtaactgcaagttgtagcattgtctcactattgtagtcatccttccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10478 - DNA, 381 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgtgcattttgttagccgtggccccgtgctggctcttgggccactgaa

SEQ ID NO: 10479 - DNA, 466 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10480 - DNA, 448 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10481 - DNA, 463 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctcgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10482 - DNA, 419 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagtggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggcactgaa

SEQ ID NO: 10483 - DNA, 422 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctgacggtgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10484 - DNA, 447 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10485 - DNA, 271 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatatttctcactctttcttctgttcttgctgtaactgcaagttgtagcattgtctcaccaatgccggatgaaccaagccgcggaggcgtcaggttttgagcttcttctatcagcattgtgcagtactgcactgccttgtgcattttgttagccgtggccccgtgctggctcttgggccactgaa

SEQ ID NO: 10486 - DNA, 413 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgcggtcctggtgcctgacggtgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgtagccttgccccgtgctggctcttgggccactgaa

SEQ ID NO: 10487 - DNA, 384 bp, Artificial; identical to SEQ ID NO: 9842
  TaSBEIIa allele with mutations introduced by TALEN pair TaSBEIIa_T03

SEQ ID NO: 10488 - DNA, 486 bp, Artificial; identical to SEQ ID NO: 8818
  TaSBEIIa allele with mutations introduced by TALEN pair TaSBEIIa_T03

SEQ ID NO: 10489 - DNA, 460 bp, Artificial; identical to SEQ ID NO: 10134
  TaSBEIIa allele with mutations introduced by TALEN pair TaSBEIIa_T03

SEQ ID NO: 10490 - DNA, 462 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggttttcgagcttcttctatcagcattgtgcagtactgcactgccttgttcattttgttagtccttggccccgtgctggctcttgggccactgaa

SEQ ID NO: 10491 - DNA, 416 bp, Artificial; identical to SEQ ID NO: 10470
  TaSBEIIa allele with mutations introduced by TALEN pair TaSBEIIa_T03

SEQ ID NO: 10492 - DNA, 404 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcgtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcgttgggccactgaa

SEQ ID NO: 10493 - DNA, 297 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcatctcctcccattctgatattttctcactctttcttctgttcttgctgtaactgcaagttgtagcaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10494 - DNA, 449 bp, Artificial; identical to SEQ ID NO: 10033
  TaSBEIIa allele with mutations introduced by TALEN pair TaSBEIIa_T03

SEQ ID NO: 10495 - DNA, 438 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgttagccggtggccccgtgctggctcgttgggccactgaa

SEQ ID NO: 10496 - DNA, 373 bp, Artificial
  TaSBEIIa allele with mutations introduced by TALEN pair TaSBEIIa_T03
gagagatagctggattaggcgatcgcctcaggccctggtgttaccacggctttgatcattcctcgtttcattctgatatatattttctcactctttttcttcctgttcttgctgtaactgcaagttgtggcgttttttcactattgtagtcatccttgcattttgcaggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgtagccttggccccgtgctggctcttgggccactgaa

SEQ ID NO: 10497 - DNA, 437 bp, Artificial; identical to SEQ ID NO: 10387
  TaSBEIIa allele with mutations introduced by TALEN pair TaSBEIIa_T03

SEQ ID NO: 10498 - DNA, 438 bp, Artificial
  TaSBEIIa allele with mutations introduced by TALEN pair TaSBEIIa_T03
  misc_feature (417): n is a or c or t or g
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccagggtcctggtgcctgacggtgagagcgacgacttggcaagtccggcgcaacctgaagattacaggtacacaccatcgtgccgggaaatcttcatacaatcgttattcacttaccaaatatcggatgaaccaagccgcggaggcatcaggttcaagcttcttctatcagcattgtgcactacttcactgccttgtgcagtttgttagctgtgccccgngctggctcttgggccactgaa

SEQ ID NO: 10499 - DNA, 405 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10500 - DNA, 396 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgagagcgacgacttggcaagtccggcgcaacctgaagaattacaggtacacaccatcgtgccgggaaatcttcatacaatcgttattcacttaccaaatgccggatgaaaaccaagccgcggaggcgtcaggttttgagcttcttctatcagcattgtgcagtactgcactgccttgtgcattttgtagccgtggccccgtgcctggctcttgggccactgaa

SEQ ID NO: 10501 - DNA, 316 bp, Artificial
  TaSBEIIa allele with mutations introduced by TALEN pair TaSBEIIa_T03
gagagatagctggataggcgatcgcctgcgtcagtgtcacccaggccctggtgttatcacggctttgatcatctcctcccattctgatattttctcactctttcttctgttcttgctgtaactgcaagttgtagcattgtccacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgttagccgtggccccgtgctggctcttgggccactgaa

SEQ ID NO: 10502 - DNA, 324 bp, Artificial
  TaSBEIIa allele with mutations introduced by TALEN pair TaSBEIIa_T03
gagagtagctggattaggcgatcgcctgcgtcagtgtcacccaggccctggtgttatcacggctttgatcatctcctcccattctgatattttctcactctttcttctgttcttgctgtaactgcaagttgtagcattgaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10503 - DNA, 445 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10504 - DNA, 430 bp, Artificial; identical to SEQ ID NO: 10283
  TaSBEIIa allele with mutations introduced by TALEN pair TaSBEIIa_T03

SEQ ID NO: 10505 - DNA, 475 bp, Artificial; identical to SEQ ID NO: 10305
  TaSBEIIa allele with mutations introduced by TALEN pair TaSBEIIa_T03

SEQ ID NO: 10506 - DNA, 329 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgttggccccgtgctggctcgttggccactgaa

SEQ ID NO: 10507 - DNA, 449 bp, Artificial
  TaSBEIIa allele with mutations introduced by TALEN pair TaSBEIIa_T03
gagagatagctggattaggcgatcgcgcttcctgaacctgtattttttcccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgtagccttggccccgtgctggctcttgggccactgaa

SEQ ID NO: 10508 - DNA, 473 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgctcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10509 - DNA, 459 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10510 - DNA, 293 bp, Artificial; identical to SEQ ID NO: 9919
  TaSBEIIa allele with mutations introduced by TALEN pair TaSBEIIa_T03

SEQ ID NO: 10511 - DNA, 437 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgcctggctcttgggccactgaa

SEQ ID NO: 10512 - DNA, 466 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagctggtgcctgacggcgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10513 - DNA, 412 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccggtgagagcgacgacttggcaagtccggcgcaacctgaagaattacaggtacacaccatcgtgccgggaaatcttcatacaatcgttaattcacttaccaaatgccggatgaaaccaagccgcggaggcgtcaggttttgagcttcttctatcagcattgtgcagtactgcactgccttgtgcattttgtagccgtggccccgtgcctggctcttgggccactgaa

SEQ ID NO: 10514 - DNA, 264 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcaaatgccggatgaaaccaagccgcggaggcgtcaggttttgagcttcttctatcagcattgtgcagtactgcactgccttgtgctattttgttagccgtggccccgtgctggctcttgggccactgaa

SEQ ID NO: 10515 - DNA, 370 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcaagtccggcgcaacctgaagaattacaggtacacaccatcgtgccgggaaatcttcatacaatcgttattcacttaccaaatgccggatgaaaccaagccgcggaggcgtcaggttttgagcttcttctatctagcattgtgcagtactgcactgccttgtgcattttgtagccgtggccccgtgcctggctcttgggccactgaa

SEQ ID NO: 10516 - DNA, 419 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagctgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgttggccccgtgctggctcttgggccactgaa

SEQ ID NO: 10517 - DNA, 475 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctggtgcctgacggcgagagcgacgacttggcaagtccggcgcaacctgaagaattacaggtacacacactcgtgccggtaaatcttcatacaatcgttattcacttaccaatgccggatgaaaccaaccacggatgcgtcaggtttcgagcttcttctatcagcattgtgcagtactgcactgccttgttctattttgttagtccttggccccgtgctggctcttgggccactgaa

SEQ ID NO: 10518 - DNA, 262 bp, Artificial; identical to SEQ ID NO: 9893
  TaSBEIIa allele with mutations introduced by TALEN pair TaSBEIIa_T03

SEQ ID NO: 10519 - DNA, 386 bp, Artificial; identical to SEQ ID NO: 10288
  TaSBEIIa allele with mutations introduced by TALEN pair TaSBEIIa_T03

SEQ ID NO: 10520 - DNA, 486 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccaccggatgcgtcaggtttcgagcttcttctatcagcattgtgcagtactgcactgccttgttcattttgttagccttggccccgtgctggctcttgggccactgaa

SEQ ID NO: 10521 - DNA, 248 bp, Artificial
  TaSBEIIa allele with mutations introduced by TALEN pair TaSBEIIa_T03
gagagtagctggattaggcgatcgcctgcgtcagtgtcacccaggccctggtgttatcacggctttgatcatctcctcccattctgatattttctcactctttcttctgttcttgcttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10522 - DNA, 477 bp, Artificial; identical to SEQ ID NO: 10171
  TaSBEIIa allele with mutations introduced by TALEN pair TaSBEIIa_T03

SEQ ID NO: 10523 - DNA, 411 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggtttgagcttcttctatcagcattgtgcagtactgcactgccttgtgcatttgtagccgtggccccgtgctggctcttgggccatgaa

SEQ ID NO: 10524 - DNA, 262 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatatttctcactctttcttctgttcttgctgtaactgcaagttgtagcaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10525 - DNA, 379 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcaagtccggcgcaacctgaagaattacaggtacacaccatcgtgccgggaaatcttcatacaatcgttattcacttaccaaatgccggatgaaaccaagccgacggaggcgtcaggttttgagcttcttctatcagcattgtgcagtactgcactgccttgtgcattttgtagccgtggccccgtgctggctcttggggccactgaa

SEQ ID NO: 10526 - DNA, 481 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcctggtgcctgacggcgagagcgacgacttggcaagtccggcgcaacctgaagaattacaggtacacacactcgtgccggtaaatcttcatacaatcgttaattcacttaccaaatgccggatgaaaaccaaccacggatgcgtcaggtttcgagcttcttctatcagcattgtgcagtactgcactgccttgttcattttgttagccttggccccgtgctggctcttgggccactgaa

SEQ ID NO: 10527 - DNA, 285 bp, Artificial; identical to SEQ ID NO: 10266
  TaSBEIIa allele with mutations introduced by TALEN pair TaSBEIIa_T03

SEQ ID NO: 10528 - DNA, 414 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattttgcaggcgccgtcctgagcgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10529 - DNA, 262 bp, Artificial; identical to SEQ ID NO: 9893
  TaSBEIIa allele with mutations introduced by TALEN pair TaSBEIIa_T03

SEQ ID NO: 10530 - DNA, 441 bp, Artificial; identical to SEQ ID NO: 10322
  TaSBEIIa allele with mutations introduced by TALEN pair TaSBEIIa_T03

SEQ ID NO: 10531 - DNA, 477 bp, Artificial; identical to SEQ ID NO: 10171
  TaSBEIIa allele with mutations introduced by TALEN pair TaSBEIIa_T03

SEQ ID NO: 10532 - DNA, 405 bp, Artificial
  TaSBEIIa allele with mutations introduced by TALEN pair TaSBEIIa_T03
gagagatagctggattaggcgatcgcctcaggccctggtgttaccacggctttgatcatctcctcctttcatgctgatattttctcactctttcttctgttcttgctgtaactgcaagttgtagcattgtctcactattgtagtcatccttgcattgcaggcgccgtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10533 - DNA, 202 bp, Artificial; identical to SEQ ID NO: 9791
  TaSBEIIa allele with mutations introduced by TALEN pair TaSBEIIa_T03

SEQ ID NO: 10534 - DNA, 406 bp, Artificial
  TaSBEIIa allele with mutations introduced by TALEN pair TaSBEIIa_T03
gagagatagctggattagggcgatcgcctgcgtcagtgtcacccaggccctggtgttatcacggctttgatcatctcctcccattctgatatttctcactctttcttctgttcttgctgtaactgcaagttgtagcattgtctcactattgtagtcatccttgcattgcagtggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 10535 - DNA, 434 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgggaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagtcttcttctatcagcattgtgcagtactgcactgccttgtgctattttgtagccgtggccccgtgctggctcgttgggccactgaa

SEQ ID NO: 10536 - DNA, 303 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgttggccccgtgctggctcttgggccactgaa

SEQ ID NO: 10537 - DNA, 473 bp, Artificial
  TaSBEIIa allele with mutations introduced by TALEN pair TaSBEIIa_T03
gagagatagctggattaggcgatcgcgcttcctgaacctgtattttttccccgcggggaaacctgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctccctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10538 - DNA, 466 bp, Artificial; identical to SEQ ID NO: 10458
  TaSBEIIa allele with mutations introduced by TALEN pair TaSBEIIa_T03

SEQ ID NO: 10539 - DNA, 403 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcgtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10540 - DNA, 423 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggcccccgtgctggctcttgggccactgaa

SEQ ID NO: 10541 - DNA, 464 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 10542 - DNA, 195 bp, Artificial; identical to SEQ ID NO: 9805
  TaSBEIIa allele with mutations introduced by TALEN pair TaSBEIIa_T03

SEQ ID NO: 10543 - DNA, 385 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgctcttgctgtaactgcaagttgtagcattgtctcactattgtagtcatccttgcattgcaggcgccgtcctgagccgcgcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 10544 - DNA, 479 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcgttgggccactgaa

SEQ ID NO: 10545 - DNA, 406 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcagtggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 10546 - DNA, 479 bp, Artificial; identical to SEQ ID NO: 10307
  TaSBEIIa allele with mutations introduced by TALEN pair TaSBEIIa_T03

SEQ ID NO: 10547 - DNA, 417 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatatttctcactctttcttctgttcttgctgtaactgcaagttgtagcattgtctcactattgtagtcatccttgcattgcaggcgccgtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgcctggctcgttgggccactgaa

SEQ ID NO: 10548 - DNA, 219 bp, Artificial
  TaSBEIIa allele with mutations introduced by TALEN pair TaSBEIIa_T03
gagagatagctggattaggcgatcgcctcaggccctggtgttaccacggctttgatcatctcctcctttcatgcacccgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10549 - DNA, 441 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 10550 - DNA, 391 bp, Artificial
  TaSBEIIa allele with mutations introduced by TALEN pair TaSBEIIa_T03
gagagatagctggattaggcgatcgcctcaggccctggtgttaccacggctttgatcattcctcgtttcattctgatatatattttctcactctttttcttcctgttcttgctgtaactgcaagttgtggcgttttttcactattgtagtcatccttgcattttgcaggcgcgagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10551 - DNA, 476 bp, Artificial
  TaSBEIIa allele with mutations introduced by TALEN pair TaSBEIIa_T03
gagagatagctggattaggcgatcgcgcttcctgaacctgtattttttcccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10552 - DNA, 459 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgcggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgtagccttggccccgtgctggctcttgggccactgaa

SEQ ID NO: 10553 - DNA, 302 bp, Artificial; identical to SEQ ID NO: 10039
  TaSBEIIa allele with mutations introduced by TALEN pair TaSBEIIa_T03

SEQ ID NO: 10554 - DNA, 435 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaggggcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10555 - DNA, 245 bp, Artificial; identical to SEQ ID NO: 10345
  TaSBEIIa allele with mutations introduced by TALEN pair TaSBEIIa_T03

SEQ ID NO: 10556 - DNA, 436 bp, Artificial; identical to SEQ ID NO: 10350
  TaSBEIIa allele with mutations introduced by TALEN pair TaSBEIIa_T03

SEQ ID NO: 10557 - DNA, 403 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcgtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgttcattttgttagccttggccccgtgctggctcttgggccactgaa

SEQ ID NO: 10558 - DNA, 479 bp, Artificial; identical to SEQ ID NO: 9018
  TaSBEIIa allele with mutations introduced by TALEN pair TaSBEIIa_T03

SEQ ID NO: 10559 - DNA, 394 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 10560 - DNA, 337 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 10561 - DNA, 441 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctgggaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10562 - DNA, 479 bp, Artificial; identical to SEQ ID NO: 9018
  TaSBEIIa allele with mutations introduced by TALEN pair TaSBEIIa_T03

SEQ ID NO: 10563 - DNA, 458 bp, Artificial; identical to SEQ ID NO: 10338
  TaSBEIIa allele with mutations introduced by TALEN pair TaSBEIIa_T03

SEQ ID NO: 10564 - DNA, 430 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcagacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10565 - DNA, 329 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcaacctgaagaattacaggtacacaccatcgtgccgggaaatcttcatacaatcgttattcacttaccaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10566 - DNA, 434 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggccctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgttagccgttggccccgtgctggctcttgggccacgtgaa

SEQ ID NO: 10567 - DNA, 423 bp, Artificial; identical to SEQ ID NO: 8932
  TaSBEIIa allele with mutations introduced by TALEN pair TaSBEIIa_T03

SEQ ID NO: 10568 - DNA, 291 bp, Artificial; identical to SEQ ID NO: 9882
  TaSBEIIa allele with mutations introduced by TALEN pair TaSBEIIa_T03

SEQ ID NO: 10569 - DNA, 416 bp, Artificial; identical to SEQ ID NO: 9823
  TaSBEIIa allele with mutations introduced by TALEN pair TaSBEIIa_T03

SEQ ID NO: 10570 - DNA, 474 bp, Artificial; identical to SEQ ID NO: 9013
  TaSBEIIa allele with mutations introduced by TALEN pair TaSBEIIa_T03

SEQ ID NO: 10571 - DNA, 425 bp, Artificial
  TaSBEIIa allele with mutations introduced by TALEN pair TaSBEIIa_T03
gagagatagctggattaggcgatcgcctcaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 10572 - DNA, 413 bp, Artificial; identical to SEQ ID NO: 10439
  TaSBEIIa allele with mutations introduced by TALEN pair TaSBEIIa_T03

SEQ ID NO: 10573 - DNA, 473 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggccctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgtagccttggccccgtgctggctcttgggccactgaa

SEQ ID NO: 10574 - DNA, 292 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggcca

SEQ ID NO: 10575 - DNA, 446 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccagggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggtttgagcttcttctatcagcattgtgcagtactgcactgccttgtgcattttgttagccgtggcccccgtgcctgggctcgttgggccacgtgaa

SEQ ID NO: 10576 - DNA, 367 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagcgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttgttagccgtggccccgtgctggctcttgggccactgaa

SEQ ID NO: 10577 - DNA, 449 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgtcatttgtagccttggccccgtgctggctcttgggccactgaa

SEQ ID NO: 10578 - DNA, 436 bp, Artificial
  TaSBEIIa allele with mutations introduced by TALEN pair TaSBEIIa_T03
gagagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttttgcaggcgccgtcctgagccgcgcggcctctccagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10579 - DNA, 444 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccagggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgttagccgtggccccgtgctggctcgttgggccactgaa

SEQ ID NO: 10580 - DNA, 261 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcaaatgccggatgaaaccaagccgcggaggcgtcaggtttcgagcttcttctatcagcattgtgcagtactgcactgccttgttcatttgttagccttggcccgtgctggctcttgggccactgaa

SEQ ID NO: 10581 - DNA, 380 bp, Artificial; identical to SEQ ID NO: 10453
  TaSBEIIa allele with mutations introduced by TALEN pair TaSBEIIa_T03

SEQ ID NO: 10582 - DNA, 418 bp, Artificial; identical to SEQ ID NO: 10061
  TaSBEIIa allele with mutations introduced by TALEN pair TaSBEIIa_T03

SEQ ID NO: 10583 - DNA, 403 bp, Artificial; identical to SEQ ID NO: 10539
  TaSBEIIa allele with mutations introduced by TALEN pair TaSBEIIa_T03

SEQ ID NO: 10584 - DNA, 394 bp, Artificial; identical to SEQ ID NO: 10397
  TaSBEIIa allele with mutations introduced by TALEN pair TaSBEIIa_T03

SEQ ID NO: 10585 - DNA, 412 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtactcatccttgcatttgcaggcgccgtcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggccactgaa

SEQ ID NO: 10586 - DNA, 379 bp, Artificial
  TaSBEIIa allele with mutations introduced by TALEN pair TaSBEIIa_T03
gagagatagctggattaggcgatcgcctgcgtcagtgtcaccccaggccctggtgttatcacggctttgatcatctcctcccattctgatattttctcactctttcttctgttcttgctgtaactgcaagttgtagcattgtctcactattgtagtcatccttgcattgcaggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcgttgggccactgaa

SEQ ID NO: 10587 - DNA, 474 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggttcgagcttcttctatcagcattgtgcagtactgcactgccttgttcattttgttagccttggccccgtgcctggctcttgggccactgaa

SEQ ID NO: 10588 - DNA, 442 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10589 - DNA, 471 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctggtgcctgacggcgagagcgacgacttggcaagtccggcgcaacctgaagaattacaggtacacacactcgtgccggtaaatcttcatacaatcgttattcacttaccaaatgccggatgaaaccacacggatgcgtcaggtttcgagcttcttctatcagcattgtgcagtactgcactgccttgttcattttgtagccttggccccgtgctggctcttgggccactgaa

SEQ ID NO: 10590 - DNA, 422 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccacgtgaa

SEQ ID NO: 10591 - DNA, 265 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcacactttcttctgttcttgctgtaactgcaagttgtagcattgtctcactattgtagtcatccgcggaggcgtcaggttttgagcttcttctatcagcattgtgcagtactgcactgccttgtgcattttgttagccgtggccccgtgctggctcttgggccactgaa

SEQ ID NO: 10592 - DNA, 416 bp, Artificial; identical to SEQ ID NO: 10470
  TaSBEIIa allele with mutations introduced by TALEN pair TaSBEIIa_T03

SEQ ID NO: 10593 - DNA, 429 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcaacctgaagaattacaggtacacacactcgtgccggtaaatcttcatacaatcgttattcacttaccaaatgccggatgaaaccaaccacggatgcgtcaggttttcgagcttcttctatcagcattgtgcagtactgcactgccttgttcattttgttagccttggccccgtgctggctcttgggccactgaa

SEQ ID NO: 10594 - DNA, 460 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggttttcgagcttcttctatcagcattgtgcagtactgcactgccttgttcattttgttagccttggccccgtgctggctcttgggccactgaa

SEQ ID NO: 10595 - DNA, 382 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10596 - DNA, 431 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttctctatcagcattgtgcagtactgcactgccttgtgcattttgttagccgtggccccgtgctggctcttgggccactgaa

SEQ ID NO: 10597 - DNA, 338 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10598 - DNA, 424 bp, Artificial
  TaSBEIIa allele with mutations introduced by TALEN pair TaSBEIIa_T03
gagagatagctggattaggcgatcgcctcaggccctggtgttaccacggctttgatcatctcctcctttcatgctgatattttctcactctttcttctgttcttgctgtaactgcaagttgtagcattgtctcactattgtagtcatccttgcattgcaggcgccgtcctgagccgcgcggcctctcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10599 - DNA, 412 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgttggccccgtgctggctcttgggccactgaa

SEQ ID NO: 10600 - DNA, 422 bp, Artificial
  TaSBEIIa allele with mutations introduced by TALEN pair TaSBEIIa_T03
  misc_feature (389): n is a or c or t or g
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccctggtgcctgacggtgagagcgacgacttggcaagtccggcgcaacctgaagaattacaggtacacaccatcgtgccgggaaatcttcatacaatcgtattcacttaccaaatgccggatgaaaccaagccgcggaggcgtcaggttttgagcttcttctatcagcattgtgcagtactgcactgccttgtgcattttgttanccgtggccccgtgctggctcttgggccactgaa

SEQ ID NO: 10601 - DNA, 383 bp, Artificial
  TaSBEIIa allele with mutations introduced by TALEN pair TaSBEIIa_T03
gagagatagctggattaggcgatcgcgcttcctgaacctgtatttttccccgcggggaaatgcgttagtgtcacccaggccctggtgttaccacggctttgatcattcctcgtttcattctgatatatattttctcactctttttcttcctgttcttgctgtaactgcaagttgtggcaagtccggcgcaacctgaagaattacaggtacacacactcgtgccggtaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10602 - DNA, 422 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttgttagccgtggccccgtgctggctcttgggccactgaa

SEQ ID NO: 10603 - DNA, 437 bp, Artificial
  TaSBEIIa allele with mutations introduced by TALEN pair TaSBEIIa_T03
gagagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcgtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 10604 - DNA, 445 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgcctggctcttgggccactgaa

SEQ ID NO: 10605 - DNA, 182 bp, Artificial
  TaSBEIIa allele with mutations introduced by TALEN pair TaSBEIIa_T03
gagagatagctggattaggcgatcgcctcaggccctggtgttatcacggcttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10606 - DNA, 479 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggcctgacggcgagagcgacgacttggcaagtccggcgcaacctgaagaattacaggtacacacactcgtgccggtaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10607 - DNA, 201 bp, Artificial; identical to SEQ ID NO: 10173
  TaSBEIIa allele with mutations introduced by TALEN pair TaSBEIIa_T03

SEQ ID NO: 10608 - DNA, 376 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagcaacctgaagaattacaggtacacaccatcgtgccgggaaatcttcatacaatcgttattcacttaccaaatgccgatgaaaccagccgcggaggcgtcaggttttgagcttcttctatcagcattgtgcagtactgcactgccttgtgcattttgtagccgtggccccgtgctggctcttgggccactgaa

SEQ ID NO: 10609 - DNA, 196 bp, Artificial; identical to SEQ ID NO: 9801
  TaSBEIIa allele with mutations introduced by TALEN pair TaSBEIIa_T03

SEQ ID NO: 10610 - DNA, 430 bp, Artificial; identical to SEQ ID NO: 10283
  TaSBEIIa allele with mutations introduced by TALEN pair TaSBEIIa_T03

SEQ ID NO: 10611 - DNA, 424 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctgacggtgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgttgctggctctttgggccactgaa

SEQ ID NO: 10612 - DNA, 311 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 10613 - DNA, 387 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgctcttgctgtaactgcaagttgtagcattgtctcactattgtagtcatccttgcattgcaggcgccgtcctgagccgcgcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgttggccccgtgctggctcttgggccactgaa

SEQ ID NO: 10614 - DNA, 454 bp, Artificial
  TaSBEIIa allele with mutations introduced by TALEN pair TaSBEIIa_T03
gagagatagctggattaaggcgatcgcgcttcctgaacctgtagttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10615 - DNA, 397 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10616 - DNA, 459 bp, Artificial
  TaSBEIIa allele with mutations introduced by TALEN pair TaSBEIIa_T03
gagagatagctggattaggcgatcgcgcttcctgaacctgtattttttcccgcgggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 10617 - DNA, 479 bp, Artificial; identical to SEQ ID NO: 9018
  TaSBEIIa allele with mutations introduced by TALEN pair TaSBEIIa_T03

SEQ ID NO: 10618 - DNA, 472 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctggtgcctgacggcgagagcgacgacttggcaagtccggcgcaacctgaagattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgtagccttggccccgtgctggctcttgggccactgaa

SEQ ID NO: 10619 - DNA, 306 bp, Artificial
  TaSBEIIa allele with mutations introduced by TALEN pair TaSBEIIa_T03
gagagatagctggattaaggcgatcgcctgcgtcagtgtcacccaggccctggtgttatcacggctttgatcatctcctcccattctgatattttctcactctttcttctgttcttgctgtaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10620 - DNA, 457 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10621 - DNA, 329 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 10622 - DNA, 442 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgttagccgtggccccgtgctggctcttgggccactgaa

SEQ ID NO: 10623 - DNA, 327 bp, Artificial
  TaSBEIIa allele with mutations introduced by TALEN pair TaSBEIIa_T03
gagagatagctggattaggcgatcgcctcaggccctggtgttaccacggctttgatcatctcctcctttcatgctgatattttctcactctttcttctgttcttgctgtaactgcaagttgtagcattgtctcactattgtagtcatccttgcattgcaggcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10624 - DNA, 379 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatatttctcactctttcttctgttcttgctgtaactgcaagttgtagcattgtctcactattgtagtcatccttgcattgcaggcaagtccggcgcaacctgaagaattacaggtacacaccatcgtgccgggaaatcttcatacaatcgttattcacttaccaaatgccggatgaaaccaagccgcggaggcgtcaggttttgagtcttcttctatcagcattgtgcagtactgcactgccttgtgctattttgttagccgtggccccgtgctggctcttgggccactgaa

SEQ ID NO: 10625 - DNA, 303 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttaccatcgtgccgggaaatcttcatacaatcgttattcacttaccaatgccggatgaaaccaagccgcggaggcgtcaggttttgagcttcttctatcagcattgtgcagtactgcactgccttgtgcattttgttagccgttggccccgttgctggctcttgggccactgaa

SEQ ID NO: 10626 - DNA, 436 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcgtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 10627 - DNA, 356 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtaagtccggcgcaacctgaagaattacaggtacacaccatcgtgccgggaaatcttcatacaatcgttattcacttaccaaatgccggatgaaaccaagccgcggaggcgtcaggtttgagcttcttctatcagcattgtgcagtactgcactgccttgtgcattttgttagccgtggccccgtgctggctcttgggccactgaa

SEQ ID NO: 10628 - DNA, 335 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgctaagttgtagcattgtctcactattgtagtcatccttgcaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 10629 - DNA, 381 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgcaagtccggcgcaacctgaagaattacaggtacacaccatcgtgccgggaaatcttcatacaatcgttattcacttaccaaatgccggatagaaaccaagccgcggaggcgtcaggttttgagcttcttctatcagcattgtgcagtactgcactgccttgtgctattttgttagccgtggccccgtgctggctcttgggccactga

SEQ ID NO: 10630 - DNA, 405 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 10631 - DNA, 366 bp, Artificial
  TaSBEIIa allele with mutations introduced by TALEN pair TaSBEIIa_T03
gagagatagctggattaggcgatcgcctcaggccctggtgttaccacggctttgatcatctcctcctttcatgctgatattttctcactctttcttctgttcttgctgtaactgcaagttgtagcattgtctcactattgtagtcatccttgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttgttagccgtggccccgtgctggctcttgggccactgaa

SEQ ID NO: 10632 - DNA, 432 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggccctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgtagccgtggccccgtgctggctcgttgggccactgaa

SEQ ID NO: 10633 - DNA, 330 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatatttctcactctttcttctgttcttgctgtaactgcaagttgtagcattgtctcactattgtagtcatcctccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10634 - DNA, 247 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatatttctcactctttcttctgttcttgcttaccaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10635 - DNA, 473 bp, Artificial
  TaSBEIIa allele with mutations introduced by TALEN pair TaSBEIIa_T03
  misc_feature (471): n is a or c or t or g
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttggccactnaa

SEQ ID NO: 10636 - DNA, 407 bp, Artificial
  TaSBEIIa allele with mutations introduced by TALEN pair TaSBEIIa_T03
gagagatagctggattaggcgatcgcctcaggccctggtgttaccacggctttgatcatctcctcccattctgatattttctcactctttcttctgttcttgctgtaactgcaagttgtagcattgtctcactattgtagtcatccttgcattgcaggcgccgtcctgagctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10637 - DNA, 335 bp, Artificial; identical to SEQ ID NO: 10414
  TaSBEIIa allele with mutations introduced by TALEN pair TaSBEIIa_T03

SEQ ID NO: 10638 - DNA, 431 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgggaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccatgaa

SEQ ID NO: 10639 - DNA, 264 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccgcggaggcgtcaggttttgagcttcttctatcagcattgtgcagtactgcactgccttgtgcattttgtagccgtggccccgtgctggctcttgggccactgaa

SEQ ID NO: 10640 - DNA, 378 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10641 - DNA, 474 bp, Artificial; identical to SEQ ID NO: 9013
  TaSBEIIa allele with mutations introduced by TALEN pair TaSBEIIa_T03

SEQ ID NO: 10642 - DNA, 252 bp, Artificial; identical to SEQ ID NO: 9940
  TaSBEIIa allele with mutations introduced by TALEN pair TaSBEIIa_T03

SEQ ID NO: 10643 - DNA, 435 bp, Artificial; identical to SEQ ID NO: 10369
  TaSBEIIa allele with mutations introduced by TALEN pair TaSBEIIa_T03

SEQ ID NO: 10644 - DNA, 394 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 10645 - DNA, 383 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcggcaagtccggcgcaacctgaagaattacaggtacacaccatcgtgccgggaaatcttcatacaatcgttattcacttaccaaatgccggatgaaaccaagccgcggtaggcgtcaggttttgagcttcttctatcagcattgtgcagtactgcactgccttgtgcattttgttagccgtggccccgtgctggctcttgggccacgtgaa

SEQ ID NO: 10646 - DNA, 248 bp, Artificial
  TaSBEIIa allele with mutations introduced by TALEN pair TaSBEIIa_T03
gagagatagctggattaggcgatcgcctcaggccctggtgttaccacggctttgatcatctcctcctttcatgctgatattttctcactctttcttctgttcttgctgtaactgcacttaccaaatatcggatgaaccaagccgcggaggcatcaggtttcaagcttcttctatcagcattgtgcactactgcactgccttgttcattttgttagccttggccccgtgctggctcttgggccactgaa

SEQ ID NO: 10647 - DNA, 430 bp, Artificial; identical to SEQ ID NO: 10283
  TaSBEIIa allele with mutations introduced by TALEN pair TaSBEIIa_T03

SEQ ID NO: 10648 - DNA, 324 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10649 - DNA, 347 bp, Artificial
  TaSBEIIa allele with mutations introduced by TALEN pair TaSBEIIa_T03
gagagatagctggattaggcgatcgcctcaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10650 - DNA, 315 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattacaatcgttattcacttaccaaatgccggatgaaaccaagccgcggaggcgtcaggttttgagcttcttctatcagcattgtgcagtactgcactgccttgtgcattttgttagccgtggccccgtgctggctcgttgggccactgaa

SEQ ID NO: 10651 - DNA, 389 bp, Artificial
  TaSBEIIa allele with mutations introduced by TALEN pair TaSBEIIa_T03
gagagatagctggattaggcgatcgcgcttcctgaacctgtatttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgacactcgtgccggtaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10652 - DNA, 199 bp, Artificial; identical to SEQ ID NO: 9811
  TaSBEIIa allele with mutations introduced by TALEN pair TaSBEIIa_T03

SEQ ID NO: 10653 - DNA, 409 bp, Artificial
  TaSBEIIa allele with mutations introduced by TALEN pair TaSBEIIa_T03
gagagatagctggattaggcgatcgcctcaggccctggtgttaccacggctttgatcattcctcgtttcattctgatattttctcactctttcttctgttcttgctgtaactgcaagttgtagcattgtctcactattgtagtcatccttgcattttgcaggcgccgtcctgagccgcgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10654 - DNA, 436 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcatctcctcccattctgatattttctcactctttcttctgttcttgctgtaactgcaagttgtagcattgtctcactattgtagtcatccttgcattgcgtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 10655 - DNA, 404 bp, Artificial
  TaSBEIIa allele with mutations introduced by TALEN pair TaSBEIIa_T03
gagagatagctggattagggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10656 - DNA, 480 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggttcgagcttcttctatcagcattgtgcagtactgcactgccttgttctattttgttagtccttggccccgtgctggctcttgggccactgaa

SEQ ID NO: 10657 - DNA, 284 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtatcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttggccactgaa

SEQ ID NO: 10658 - DNA, 264 bp, Artificial; identical to SEQ ID NO: 10639
  TaSBEIIa allele with mutations introduced by TALEN pair TaSBEIIa_T03

SEQ ID NO: 10659 - DNA, 414 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtccggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 10660 - DNA, 454 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10661 - DNA, 425 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcgtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggtttgagcttcttctatcagcattgtgcagtactgcactgccttgtgctattttgttagccgtggccccgtgctggctcgttgggccactgaa

SEQ ID NO: 10662 - DNA, 442 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgaggcttcttctatcagcattgtgcagtactgcactgccttgtgcattttgttagccgtggccccgtgctggctcttgggccactgaa

SEQ ID NO: 10663 - DNA, 462 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctcgagagcgacgacttggcaagtccggcgcaacctgaagaattacaggtacacacactcgtgccggtaaatcttcatacaatcgttattcacttaccaaatgccggatgaaaccaccacggatgcgtcaggttttcgagcttcttctatcagcattgtgcagtactgcactgccttgttcattttgttagccttggccccgtgctggctcttgggccactgaa

SEQ ID NO: 10664 - DNA, 453 bp, Artificial; identical to SEQ ID NO: 10154
  TaSBEIIa allele with mutations introduced by TALEN pair TaSBEIIa_T03

SEQ ID NO: 10665 - DNA, 424 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcgggcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10666 - DNA, 416 bp, Artificial; identical to SEQ ID NO: 10470
  TaSBEIIa allele with mutations introduced by TALEN pair TaSBEIIa_T03

SEQ ID NO: 10667 - DNA, 426 bp, Artificial
  TaSBEIIa allele with mutations introduced by TALEN pair TaSBEIIa_T03
gagagatagctggattagggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10668 - DNA, 434 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10669 - DNA, 412 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttctctatcagcattgtgcagtactgcactgccttgttcattttgttagccttggccccgcgctggctcttgggccactgaa

SEQ ID NO: 10670 - DNA, 442 bp, Artificial; identical to SEQ ID NO: 10622
  TaSBEIIa allele with mutations introduced by TALEN pair TaSBEIIa_T03

SEQ ID NO: 10671 - DNA, 486 bp, Artificial; identical to SEQ ID NO: 8818
  TaSBEIIa allele with mutations introduced by TALEN pair TaSBEIIa_T03

SEQ ID NO: 10672 - DNA, 430 bp, Artificial
  TaSBEIIa allele with mutations introduced by TALEN pair TaSBEIIa_T03
  misc_feature (126): n is a or c or t or g
gagagatagctggattaggcgatcgcgcttcctgaacctgtattttttccccgcggggaaatgcgttagtgtcacccaggccctggtgttaccacggctttgatcattcctcgtttcattctgatntatattttctcactctttttcttcctgttcttgctgtaactgcaagttgtggcgttttttcactattgtagtcatccttgcattttgcaggcgccgtcgcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10673 - DNA, 440 bp, Artificial
  TaSBEIIa allele with mutations introduced by TALEN pair TaSBEIIa_T03
gagagatagctggattaggcgatcgcctgcgtcagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcgcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagccttggccccgtgctggctcttgggccactgaa

SEQ ID NO: 10674 - DNA, 429 bp, Artificial
  TaSBEIIa allele with mutations introduced by TALEN pair TaSBEIIa_T03
gagagatagctggattaggcgatcgcctcaggccctggtgttaccacggctttgatcattcctcgtttcattctgatatatattttctcactctttttcttcctgttcttgctgtaactgcaagttgtggcgtttttcactattgtagtcatccttgcattttgcaggcgccgtcctgagccgcgcggcctcctggtgcctgacggcgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10675 - DNA, 457 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcggagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagtccttggccccgtgctggctcttgggccactgaa

SEQ ID NO: 10676 - DNA, 479 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgtagccttggccccgtgctggctcgttgggccactgaa

SEQ ID NO: 10677 - DNA, 469 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 10678 - DNA, 442 bp, Artificial
  TaSBEIIa allele with mutations introduced by TALEN pair TaSBEIIa_T03
  misc_feature (385); (421): n is a or c or t or g
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccagggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtacngcactgccttgtgcattttgtagccgttggccccgngctggctcttgggccactgaa

SEQ ID NO: 10679 - DNA, 424 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggtttgagcttcttctatcagcattgtgcagtactgcactgccttgtgctattttgtagccgtggccccgtgctggctcttgggccactgaa

SEQ ID NO: 10680 - DNA, 460 bp, Artificial; identical to SEQ ID NO: 10134
  TaSBEIIa allele with mutations introduced by TALEN pair TaSBEIIa_T03

SEQ ID NO: 10681 - DNA, 377 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagcaacctgaagaattacaggtacacaccatcgtgccgggaaatcttcatacaatcgttattcacttaccaaatgccggatgaaaccaagccgcggaggcgtcaggttttgagcttcttctatcagcattgtgcactacttcactgccttgtgcagtttgtagctgtggcccgcgctggctcttgggccactgaa

SEQ ID NO: 10682 - DNA, 414 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10683 - DNA, 426 bp, Artificial
  TaSBEIIa allele with mutations introduced by TALEN pair TaSBEIIa_T03
  misc_feature (405): n is a or c or t or g
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcatttgcaggcgccgtcctgaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgtagctgtggccccgngctggctcttgggccactgaa

SEQ ID NO: 10684 - DNA, 403 bp, Artificial; identical to SEQ ID NO: 10253
  TaSBEIIa allele with mutations introduced by TALEN pair TaSBEIIa_T03

SEQ ID NO: 10685 - DNA, 228 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcggaggcgtcaggttttgagcttcttctatcagcattgtgcagtactgcactgccttgtgcattttgtagccgtggccccgtgctggctcttgggccactgaa

SEQ ID NO: 10686 - DNA, 486 bp, Artificial; identical to SEQ ID NO: 8818
  TaSBEIIa allele with mutations introduced by TALEN pair TaSBEIIa_T03

SEQ ID NO: 10687 - DNA, 447 bp, Artificial; identical to SEQ ID NO: 10239
  TaSBEIIa allele with mutations introduced by TALEN pair TaSBEIIa_T03

SEQ ID NO: 10688 - DNA, 425 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgtggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10689 - DNA, 434 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgacttggcaagtccggcgcaacctgaagaattacaggtacacacactcgtgccggtaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10690 - DNA, 376 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactga

SEQ ID NO: 10691 - DNA, 394 bp, Artificial; identical to SEQ ID NO: 10397
  TaSBEIIa allele with mutations introduced by TALEN pair TaSBEIIa_T03

SEQ ID NO: 10692 - DNA, 251 bp, Artificial; identical to SEQ ID NO: 10029
  TaSBEIIa allele with mutations introduced by TALEN pair TaSBEIIa_T03

SEQ ID NO: 10693 - DNA, 473 bp, Artificial; identical to SEQ ID NO: 10036
  TaSBEIIa allele with mutations introduced by TALEN pair TaSBEIIa_T03

SEQ ID NO: 10694 - DNA, 469 bp, Artificial
  TaSBEIIa allele with mutations introduced by TALEN pair TaSBEIIa_T03
  misc_feature (448): n is a or c or t or g
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggtgcctgacggcgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgngctggctcttgggccactgaa

SEQ ID NO: 10695 - DNA, 463 bp, Artificial
  TaSBEIIa allele with mutations introduced by TALEN pair TaSBEIIa_T03
gagagatagctggattaggcgatcgcgcttcctgaacctgttattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctgcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgtagccttggccccgtgctggctcttgggccactgaa

SEQ ID NO: 10696 - DNA, 487 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagccttggccccgtgctggctcttgggccactcgaa

SEQ ID NO: 10697 - DNA, 436 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgttggccccgtgctggctcttgggccactgaa

SEQ ID NO: 10698 - DNA, 470 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcatctcctcccattctgatattttctcactctttcttctgttcttgctgtaactgcaagttgtagcattgtctcactattgtagtcatccttgcattgcaggcgccgtcctgagccgcgcggcctctccagggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10699 - DNA, 300 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttaccatcgtgccgggaaatcttcatacaatcgttattcacttaccaaatgccggatgaaaccaagccgcggaggcgtcaggttttgagcttcttctatcagcattgtgcagtactgcactgccttgtgcatttgttagccgtggcccgtgctggctcttgggccactgaa

SEQ ID NO: 10700 - DNA, 430 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctggtgcctggacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 10701 - DNA, 429 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcgctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgttagccgtggccccgtgctggctcttgggccactgaa

SEQ ID NO: 10702 - DNA, 477 bp, Artificial; identical to SEQ ID NO: 10171
  TaSBEIIa allele with mutations introduced by TALEN pair TaSBEIIa_T03

SEQ ID NO: 10703 - DNA, 196 bp, Artificial; identical to SEQ ID NO: 9801
  TaSBEIIa allele with mutations introduced by TALEN pair TaSBEIIa_T03

SEQ ID NO: 10704 - DNA, 464 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10705 - DNA, 473 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagccttcggccccgtgctggctcttgggccactgaa

SEQ ID NO: 10706 - DNA, 483 bp, Artificial; identical to SEQ ID NO: 9402
  TaSBEIIa allele with mutations introduced by TALEN pair TaSBEIIa_T03

SEQ ID NO: 10707 - DNA, 408 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttgttagccgtggccccgtgctggctcttgggccactgaa

SEQ ID NO: 10708 - DNA, 444 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccagggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcactacttcactgccttgtgcagtttgttagctgtggccccgcgctgggctcgttgggccactgaa

SEQ ID NO: 10709 - DNA, 430 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcgcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10710 - DNA, 474 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgtagccttggccccgtgctggctcttgggccactgaa

SEQ ID NO: 10711 - DNA, 323 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatatttctcactctttcttctgttcttgctgtaactgcaagttgtagcattgtctcactattgtagtcatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10712 - DNA, 387 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgttagccgtggccccgtgctggctcttgggccactgaa

SEQ ID NO: 10713 - DNA, 389 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcgttgggccactgaa

SEQ ID NO: 10714 - DNA, 292 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10715 - DNA, 396 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggccaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttgtagccgtggcccgtgctggctcttgggccactgaa

SEQ ID NO: 10716 - DNA, 263 bp, Artificial
  TaSBEIIa allele with mutations introduced by TALEN pair TaSBEIIa_T03
  misc_feature (198): n is a or c or t or g
gagagatagctggattaggcgatcgcctgcgtcagtgtcacccaggccctggtgttatcacggctttgatcatctcctcccattctgatattttctcactctttcttctgttcttgctgtaactgcaagttgtagcaaatgccggatgaaaccaagccgcggaggcgtcaggttttgagcttcttctatcagcattgngcagtactgcactgccttgtgcatttgttagccgtggccccgtagctggctcttgggccactgaa

SEQ ID NO: 10717 - DNA, 440 bp, Artificial
  TaSBEIIa allele with mutations introduced by TALEN pair TaSBEIIa_T03
gagagatagctggattaggcgatctcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggcactgaa

SEQ ID NO: 10718 - DNA, 442 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccagggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcgttgggccactgaa

SEQ ID NO: 10719 - DNA, 475 bp, Artificial; identical to SEQ ID NO: 8990
  TaSBEIIa allele with mutations introduced by TALEN pair TaSBEIIa_T03

SEQ ID NO: 10720 - DNA, 435 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgcctggctcgttgggccacgaa

SEQ ID NO: 10721 - DNA, 377 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgtagccgtggccccgtgctggctcgttggggccactgaa

SEQ ID NO: 10722 - DNA, 357 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10723 - DNA, 265 bp, Artificial; identical to SEQ ID NO: 9938
  TaSBEIIa allele with mutations introduced by TALEN pair TaSBEIIa_T03

SEQ ID NO: 10724 - DNA, 456 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgtcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 10725 - DNA, 467 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggcccctgctggctctagggccactgaa

SEQ ID NO: 10726 - DNA, 485 bp, Artificial; identical to SEQ ID NO: 8782
  TaSBEIIa allele with mutations introduced by TALEN pair TaSBEIIa_T03

SEQ ID NO: 10727 - DNA, 291 bp, Artificial; identical to SEQ ID NO: 9882
  TaSBEIIa allele with mutations introduced by TALEN pair TaSBEIIa_T03

SEQ ID NO: 10728 - DNA, 422 bp, Artificial
  TaSBEIIa allele with mutations introduced by TALEN pair TaSBEIIa_T03
  misc_feature (401): n is a or c or t or g
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctgacggtgagagcgacgacttggcggccactccagcgcaacccgaagaattacaggtacacaccgtcgtgccggaaaatcttcatgcacccgttatcacttaccaatatcggatgaaccaagccgcggagcatcaggtttcaagcttcttctatcagcattgtgcactacttcactgccttgtgcagtttgttagctgtggccccgngctggctcttgggccactgaa

SEQ ID NO: 10729 - DNA, 463 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 10730 - DNA, 400 bp, Artificial
  TaSBEIIa allele with mutations introduced by TALEN pair TaSBEIIa_T03
gagagatagctggattaggcgatcgcctcaggccctggtgttaccacggctttgatcatctcctcctttcatgctgatattttctcactctttcttctgttcttgctgtaactgcaagttgtggcgttttttcactattgtagtcatccttgcattttgcaggcgccgtcctgacggcgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10731 - DNA, 253 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccaccatcgtgccgggaaatcttcatacaatcgttattcacttaccaaatgccggatgaaaccaagccgcggaggcgtcaggttttgagcttcttctatcagcattgtgcagtactgcactgccttgtgctattttgttagccgtggccccgtgctggctcttgggccactgaa

SEQ ID NO: 10732 - DNA, 422 bp, Artificial; identical to SEQ ID NO: 10602
  TaSBEIIa allele with mutations introduced by TALEN pair TaSBEIIa_T03

SEQ ID NO: 10733 - DNA, 474 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggtcctggtgcctgacggcgagagcgacgacttggcaagtccggcgcaacctgaagaattacaggtacacacactcgtgccggtaaatcttcatacaatcgttatcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10734 - DNA, 306 bp, Artificial
  TaSBEIIa allele with mutations introduced by TALEN pair TaSBEIIa_T03
gagagatagctggattaggcgatcgcctcaggccctggtgttaccacggctttgatcattcctcgtttcattctgatatatattttctcactctttttcttcctgttcttgctgtaactgcaagttgtggcgttttttcactattgtagtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10735 - DNA, 475 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctggtgcctgacggcgagagcgacgacttggcaagtccggcgcaacctgaagaattacaggtacacacactcgtgcccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10736 - DNA, 390 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgcctggctcttgggccactgaa

SEQ ID NO: 10737 - DNA, 487 bp, Artificial
  TaSBEIIa allele with mutations introduced by TALEN pair TaSBEIIa_T03
gagagatagctggattaggcgatcgcgcttcctgaacctgtattttttcccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggtcctggtgcctgacggcgagagcgacgacttggcaagtccggcgcaacctgaagaattacaggtacacacactcgtgccggtaaatcttcatacaatcgttatcacttaccaaatgccggatgaaaccaaccacggatgcgtcaggtttcgagcttcttctatcagcattgtgcagtactgcactgccttgttctattttgttagtccttggccccgtgctggctcgttgggccactgaa

SEQ ID NO: 10738 - DNA, 473 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccctgacggcgagagcgacgacttggcaagtccggcgcaacctgaagaattacaggtacacacactcgtgccggtaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 10739 - DNA, 478 bp, Artificial; identical to SEQ ID NO: 8889
  TaSBEIIa allele with mutations introduced by TALEN pair TaSBEIIa_T03

SEQ ID NO: 10740 - DNA, 406 bp, Artificial
  TaSBEIIa allele with mutations introduced by TALEN pair TaSBEIIa_T03
gagagatagctggattaggcgatcgcctcaggccctggtgttaccacggctttgatcattcctcgtttcattctgatatatattttctcactctttttcttcctgttcttgctgtaactgcaagttgtggcgttttttcactattgtagtcatccttgcattttgcaggcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10741 - DNA, 468 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggtgcctgacggcgagagcgacgacttggcaagtccggcgcaacctgaagaattacaggtacacacactcgtgccggtaaatcttcatacaatcgttattcacttaccaatgccggatgaaaccaccacggatgcgtcaggtttcgagcttcttctatcagcattgtgcagtactgcactgccttgttcattttgttagccttggccccgtgcctggctcttgggccactgaa

SEQ ID NO: 10742 - DNA, 461 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagcgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggttttccgagtcttcttctatcagcattgtgcagtactgcactgccttgttcattttgttagtccttggccccgtgctggctcttgggccactgaa

SEQ ID NO: 10743 - DNA, 459 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 10744 - DNA, 404 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgcccttgtgcagtttgtagctgtcggccccgcgctggctcgttgggccacgtgaa

SEQ ID NO: 10745 - DNA, 400 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggccaagtccggcgcaacctgaagaattacaggtacacaccatcgtgccgggaatcttcatacaatcgttattcacttaccaaatgccggatgaaaccaagccgcggaggcgtcaggttttgagcttcttctatcagcattgtgcagtactgcactgccttgtgctattttgttagccgtggccccgtgcctggctcttgggccactgaa

SEQ ID NO: 10746 - DNA, 475 bp, Artificial; identical to SEQ ID NO: 10305
  TaSBEIIa allele with mutations introduced by TALEN pair TaSBEIIa_T03

SEQ ID NO: 10747 - DNA, 480 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctctggtgcctgacggcgagagcgacgacttggcaagtccggcgcaacctgaagaattacaggtacacacactcgtgccggtaaatcttcatacaatcgttattcacttaccaaatgccggatgaaaaccaaccacggatgcgtcaggtttcgagcttcttctatcagcattgtgcagtactgcactgccttgttctattttgttagccttggccccgtgctggctcttgggccactgaa

SEQ ID NO: 10748 - DNA, 379 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttaacctgaagaattacaggtacacacactcgtgccggtaaatcttcatacaatcgttattcacttaccaaatgccggatgaaaccaagccgcggaggcgtcaggttttgagcttcttctatcagcattgtgcagtactgcactgccttgtgctattttgttagccgtggccccgtgctggctcttgggccactgaa

SEQ ID NO: 10749 - DNA, 358 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgttggccccgtgctggctcttgggccactgaa

SEQ ID NO: 10750 - DNA, 471 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgttgctggctcttgggccactgaa

SEQ ID NO: 10751 - DNA, 406 bp, Artificial; identical to SEQ ID NO: 9887
  TaSBEIIa allele with mutations introduced by TALEN pair TaSBEIIa_T03

SEQ ID NO: 10752 - DNA, 199 bp, Artificial; identical to SEQ ID NO: 9811
  TaSBEIIa allele with mutations introduced by TALEN pair TaSBEIIa_T03

SEQ ID NO: 10753 - DNA, 378 bp, Artificial; identical to SEQ ID NO: 10301
  TaSBEIIa allele with mutations introduced by TALEN pair TaSBEIIa_T03

SEQ ID NO: 10754 - DNA, 195 bp, Artificial; identical to SEQ ID NO: 9876
  TaSBEIIa allele with mutations introduced by TALEN pair TaSBEIIa_T03

SEQ ID NO: 10755 - DNA, 285 bp, Artificial; identical to SEQ ID NO: 10266
  TaSBEIIa allele with mutations introduced by TALEN pair TaSBEIIa_T03

SEQ ID NO: 10756 - DNA, 419 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagtggtgcctgacggtgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10757 - DNA, 487 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtccctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatccagcattgtgcagtactgcactgccttgttcattttgttagccttggccccgtgctggctcttgggccactgaa

SEQ ID NO: 10758 - DNA, 474 bp, Artificial; identical to SEQ ID NO: 9013
  TaSBEIIa allele with mutations introduced by TALEN pair TaSBEIIa_T03

SEQ ID NO: 10759 - DNA, 307 bp, Artificial
  TaSBEIIa allele with mutations introduced by TALEN pair TaSBEIIa_T03
gagagatagctggattaaggcgatcgcctgcgtcagtgtcacccaggccctggtgttatcacggctttgatcatctcctcccattctgatattttctcactctttcttctgttcttgctgtaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgttagccgtggccccgtgctggctcttgggccactgaa

SEQ ID NO: 10760 - DNA, 371 bp, Artificial
  TaSBEIIa allele with mutations introduced by TALEN pair TaSBEIIa_T03
  misc_feature (327): n is a or c or t or g
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgngcattttgtagccgtggccccgtgctggctcttgggccactgaa

SEQ ID NO: 10761 - DNA, 348 bp, Artificial; identical to SEQ ID NO: 9934
  TaSBEIIa allele with mutations introduced by TALEN pair TaSBEIIa_T03

SEQ ID NO: 10762 - DNA, 431 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagtcttcttctatcagcattgtgcagtactgcactgccttgtgcattttgttagccgtggccccgtgctggctcttgggccatgaa

SEQ ID NO: 10763 - DNA, 476 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggaaggtcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgtcattttgtagccttggccccgtgctggctcttgggccactgaa

SEQ ID NO: 10764 - DNA, 478 bp, Artificial; identical to SEQ ID NO: 8889
  TaSBEIIa allele with mutations introduced by TALEN pair TaSBEIIa_T03

SEQ ID NO: 10765 - DNA, 381 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10766 - DNA, 424 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgttagccgtggccccgtgctggctcttgggccactgaa

SEQ ID NO: 10767 - DNA, 469 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcgggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgtcattttgttagccttggccccgtgctggctcttgggccactgaa

SEQ ID NO: 10768 - DNA, 432 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgctattttgcagacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10769 - DNA, 430 bp, Artificial; identical to SEQ ID NO: 10564
  TaSBEIIa allele with mutations introduced by TALEN pair TaSBEIIa_T03

SEQ ID NO: 10770 - DNA, 442 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgtagccttggccccgtgctggctcttgggccactgaa

SEQ ID NO: 10771 - DNA, 313 bp, Artificial
  TaSBEIIa allele with mutations introduced by TALEN pair TaSBEIIa_T03
gagagatagctggattaggcgatcgcctcaggccctggtgttaccacggctttgatcatctcctcctttcatgctgatattttctcactctttcttctgttcttgctgtaactgcagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcagtactgcactgccttgtgcattttgttagccgtggccccgtgctggctcttgggccactgaa

SEQ ID NO: 10772 - DNA, 412 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcatttgcaggcgccgtcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggccactgaa

SEQ ID NO: 10773 - DNA, 452 bp, Artificial
  TaSBEIIa allele with mutations introduced by TALEN pair TaSBEIIa_T03
gagagatagctggattaggcaatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 10774 - DNA, 439 bp, Artificial
  TaSBEIIa allele with mutations introduced by TALEN pair TaSBEIIa_T03
gagagatagctggattaggcgatcgcctcaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagcctttggccccgtgctggctcttgggccactgaa

SEQ ID NO: 10775 - DNA, 444 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcatctcctcccattctgatattttctcactctttcttctgttcttgctgtaactgcaagttgtagcattgtctcactattgtagtcatccttgcattgcaggcgccgtcctgagccgcgcgggcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10776 - DNA, 428 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgttagccgtggccccgtgctggctcttgggccactgaa

SEQ ID NO: 10777 - DNA, 378 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 10778 - DNA, 434 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaggggcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 10779 - DNA, 453 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtctgacggcgagagcgacgacttggcaagtccggcgcaacctgaagaattacaggtacacacactcgtgccggtaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10780 - DNA, 196 bp, Artificial; identical to SEQ ID NO: 9801
  TaSBEIIa allele with mutations introduced by TALEN pair TaSBEIIa_T03

SEQ ID NO: 10781 - DNA, 472 bp, Artificial
  TaSBEIIa allele with mutations introduced by TALEN pair TaSBEIIa_T03
gagagatgctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10782 - DNA, 440 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccagggcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggtttgagcttcttctatcagcattgtgcagtactgcactgccttgtgcattttgttagccgtggccccgtgctggctcttgggccactgaa

SEQ ID NO: 10783 - DNA, 419 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtccctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgaggcttcttctatcagcattgtgcagtactgcactgccttgtgcattttgttagccgtggcccccgtgctggctcttgggccactgaa

SEQ ID NO: 10784 - DNA, 456 bp, Artificial
  TaSBEIIa allele with mutations introduced by TALEN pair TaSBEIIa_T03
gagagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10785 - DNA, 455 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagcgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccacta

SEQ ID NO: 10786 - DNA, 425 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcatcaggtttcaagcttcttctatcagcattgtgcactacttcactgccttgtgcagtttgtagctgtggcccgcgctggctcttgggccactgaa

SEQ ID NO: 10787 - DNA, 431 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10788 - DNA, 262 bp, Artificial; identical to SEQ ID NO: 9893
  TaSBEIIa allele with mutations introduced by TALEN pair TaSBEIIa_T03

SEQ ID NO: 10789 - DNA, 462 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10790 - DNA, 438 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcggagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10791 - DNA, 359 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcaagtccggcgcaacctgaagaattacaggtacacaccatcgtgccgggaaatcttcatacaatcgttattcacttaccaaatgccggatgaaaccaagccgcggaggcgtcaggtttgagcttcttctatcagcattgtgcagtactgcactgccttgtgcattttgtagccgtggccccgtgctggctcttgggccactgaa

SEQ ID NO: 10792 - DNA, 262 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcaaatgccggatgaaaccaagccgcggaggcgtcaggttttgagcttcttctatcagcattgtgcagtactgcactgccttgtgcatttgttagccgtggccccgtgctggctcttgggccactgaa

SEQ ID NO: 10793 - DNA, 482 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctctggtgcctgacggcgagagcgacgacttggcaagtccggcgcaacctgaagaattacaggtacacacactcgtgccggtaaatcttcatacaatcgttattcacttaccaaatgccggatgaaaccaccacggactgcgtcaggtttcgagcttcttctatcagcattgtgcagtactgcactgccttgttctattttgttagtccttggccccgtgctggctcgttgggcctactgaa

SEQ ID NO: 10794 - DNA, 274 bp, Artificial
  TaSBEIIa allele with mutations introduced by TALEN pair TaSBEIIa_T03
gagagatagctggattaggcgatcgcctcaggccctggtgttaccacggctttgatcatctcctcctttcatgctgatattttctcactctttcttctgttcttgctgtaactgcaagttgtatcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10795 - DNA, 456 bp, Artificial
  TaSBEIIa allele with mutations introduced by TALEN pair TaSBEIIa_T03
gagagatagctggattaggcgatcgcgcttcctgaacctgttattttttccccgcggggaaatgcgttagtgtcacccaggccctggtgttaccacggctttgatcattcctcgtttcattctgatatatattttctcactctttttcttcctgttcttgctgtaactgcaagttgtggtcgttttttcactattgtagtcatccttgcattttgcaggcgccgtcctgagccgcggagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcatttgttagccttggccccgtgctggctcttgggccactgaa

SEQ ID NO: 10796 - DNA, 430 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcgcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgtagtccgtggccccgtgctggctcttgggccactgaa

SEQ ID NO: 10797 - DNA, 473 bp, Artificial
  TaSBEIIa allele with mutations introduced by TALEN pair TaSBEIIa_T03
gagagataagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgtagccttggccccgtgctggctcttgggccactgaa

SEQ ID NO: 10798 - DNA, 457 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcgagagcgacgacttggcaagtccggcgcaacctgaagaattacaggtacacacactcgtgccggtaaatcttcatacaatcgttattcacttaccaaatgccggatgaaaccacacggatgcgtcaggtttcgagcttcttctatcagcattgtgcagtactgcactgccttgttcattttgttagccttggccccgtgctggctcttgggccactgaa

SEQ ID NO: 10799 - DNA, 329 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttcgtgccgggaaatcttcatacaatcgttattcacttaccaaatgccggatgaaaccaagccgcggaggcgtcaggtttgagcttcttctatcagcattgtgcagtactgcactgccttgtgctattttgttagccgtggccccgtgctggctcgttgggccactgaa

SEQ ID NO: 10800 - DNA, 468 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctaggtcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgcctttgttcattttgttagccttggccccgttgcctggctcttgggccatgaa

SEQ ID NO: 10801 - DNA, 485 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggtcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 10802 - DNA, 474 bp, Artificial; identical to SEQ ID NO: 9013
  TaSBEIIa allele with mutations introduced by TALEN pair TaSBEIIa_T03

SEQ ID NO: 10803 - DNA, 436 bp, Artificial
  TaSBEIIa allele with mutations introduced by TALEN pair TaSBEIIa_T03
gagagatagctggattagggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccagggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 10804 - DNA, 418 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagcctgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 10805 - DNA, 377 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagcaacctgaagaattacaggtacacaccatcgtgccggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 10806 - DNA, 481 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggagcctgacggcgagagcgacgacttggcaagtccggcgcaacctgaagaattacaggtacactacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10807 - DNA, 415 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcatctcctcccattctgatattttctcactctttcttctgttcttgctgtaactgcaagttgtagcattgtctcactattgtagtcatccttgcattgcaggcgccaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgttcattttgttagccttggccccgtgctggctcttgggccactgaa

SEQ ID NO: 10808 - DNA, 450 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagccttggccccgtgctggctcgttgggccactgaa

SEQ ID NO: 10809 - DNA, 447 bp, Artificial
  TaSBEIIa allele with mutations introduced by TALEN pair TaSBEIIa_T03
  misc_feature (426): n is a or c or t or g
gagagatagctggattaggcgatcgcctgcgtcagtgtcacccaggccctggtgttatcacggctttgatcatctcctcccattctgatattttctcactctttcttctgttcttgctgtaactgcaagttgtagctatttttttggcaaataagttgtagcattgtctcagtattgtactcatccttgcatttgcaggcgccgtcctgaggtgcctgacggtgagagcgacgacttggcggccactccagcgcaacccgaagaattacaggtacacaccgtcgtgccggaaaatcttcatgcacccgttattcacttaccaaatactcggatgaaccaagccgcggaggcatcaggtttcaagcttcttctatcagcattgtgcactacttcactgccttgtgcagtttgtagctgtggccccgngctggctcttgggccactgaa

SEQ ID NO: 10810 - DNA, 471 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggtggtgcctgacggcgagagcgacgacttggcaagtccggcgcaacctgaagaattacaggtacacacactcgtgaccggtaaatcttcatacaatcgttattcacttaccaaatgccggatgaaaccagccgcggaggcgtcaggttttgagcttcttctatcagcattgtgcagtactgcactgccttgtgcattttgtagccgtggccccgtgctggctcttgggccatgaa

SEQ ID NO: 10811 - DNA, 423 bp, Artificial; identical to SEQ ID NO: 8932
  TaSBEIIa allele with mutations introduced by TALEN pair TaSBEIIa_T03

SEQ ID NO: 10812 - DNA, 330 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10813 - DNA, 434 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggcccccgtgctggctcttgggccactgaa

SEQ ID NO: 10814 - DNA, 473 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggtcctggtgcctgacggcgagagcgacgacttggcaagtccggcgcaacctgagaattacaggtacacacactcgtgccggtaaatcttcatacaatcgttattcacttaccaaatgccggatgaaaccaaccacggatgcgtcaggtttcgagctcttctatcagcattgtgcagtactgcactgccttgttcattttgttagccttggccccgtgctggctcttgggccactgaa

SEQ ID NO: 10815 - DNA, 477 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcgtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagtccttggcccccgtgctggctcgttgggccactgaa

SEQ ID NO: 10816 - DNA, 449 bp, Artificial; identical to SEQ ID NO: 10033
  TaSBEIIa allele with mutations introduced by TALEN pair TaSBEIIa_T03

SEQ ID NO: 10817 - DNA, 406 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggcctcttgggccactgaa

SEQ ID NO: 10818 - DNA, 453 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgtagccttggccccgtgctggctcttgggccactgaa

SEQ ID NO: 10819 - DNA, 477 bp, Artificial
  TaSBEIIa allele with mutations introduced by TALEN pair TaSBEIIa_T03
  misc_feature (456): n is a or c or t or g
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggcctgacggcgagagcgacgacttggcaagtccggcgcaacctgaagaattacaggtacacacactcgtgccggtaaatcttcatacaatcgttatcacttaccaaatgccggatgaaaccaaccacggatgcgtcaggtttcgagcttcttctatcagcattgtgcagtactgcactgccttgtgcagtttgttagctgtggccccgngctggctcttgggccactgaa

SEQ ID NO: 10820 - DNA, 356 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 10821 - DNA, 265 bp, Artificial; identical to SEQ ID NO: 9938
  TaSBEIIa allele with mutations introduced by TALEN pair TaSBEIIa_T03

SEQ ID NO: 10822 - DNA, 460 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcgcgagagcgacgacttggcaagtccggcgcaacctgaagaattacaggtacacacactcgtgccggtaaatcttcatacaatcgttattcacttaccaaatgccggatgaaaccaaccacggatgcgtcaggttttcgagcttcttctatcagcattgtgcagtactgcactgccttgttcattttgttagccttggccccgttgctggctcttgggccactgaa

SEQ ID NO: 10823 - DNA, 432 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgggaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10824 - DNA, 402 bp, Artificial
  TaSBEIIa allele with mutations introduced by TALEN pair TaSBEIIa_T03
gagagatagctggattaggcgatcgcctgcgtcagtgtcacccaggtcctggtgttatcacggctttgatcatctcctcccattctgatattttctcactctttcttctgttcttgctgtaactgcaagttgtagcattgtctcactattgtagtcatccttgcattgctgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10825 - DNA, 410 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagcggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10826 - DNA, 478 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttgccccgtgctggctcttgggccactgaa

SEQ ID NO: 10827 - DNA, 467 bp, Artificial; identical to SEQ ID NO: 9077
  TaSBEIIa allele with mutations introduced by TALEN pair TaSBEIIa_T03

SEQ ID NO: 10828 - DNA, 427 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10829 - DNA, 460 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagtccttggccccgtgctggctcttgggccactgaa

SEQ ID NO: 10830 - DNA, 463 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctgcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgtagccttggccccgtgcctggctcttgggccactgaa

SEQ ID NO: 10831 - DNA, 477 bp, Artificial; identical to SEQ ID NO: 10171
  TaSBEIIa allele with mutations introduced by TALEN pair TaSBEIIa_T03

SEQ ID NO: 10832 - DNA, 428 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgttgctggctcttgggccactgaa

SEQ ID NO: 10833 - DNA, 327 bp, Artificial; identical to SEQ ID NO: 9961
  TaSBEIIa allele with mutations introduced by TALEN pair TaSBEIIa_T03

SEQ ID NO: 10834 - DNA, 441 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccagggcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10835 - DNA, 334 bp, Artificial; identical to SEQ ID NO: 10407
  TaSBEIIa allele with mutations introduced by TALEN pair TaSBEIIa_T03

SEQ ID NO: 10836 - DNA, 430 bp, Artificial
  TaSBEIIa allele with mutations introduced by TALEN pair TaSBEIIa_T03
gagagatagctggattagggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgttagccgtggccccgtgctggctcgttgggccactgaa

SEQ ID NO: 10837 - DNA, 401 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgcggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcgttgggccacgtgaa

SEQ ID NO: 10838 - DNA, 474 bp, Artificial; identical to SEQ ID NO: 9013
  TaSBEIIa allele with mutations introduced by TALEN pair TaSBEIIa_T03

SEQ ID NO: 10839 - DNA, 429 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcaagtccggcgcaacctgaagaattacaggtacacacactcgtgccggtaaatcttcatacaatcgttattcacttaccaaatgccggatgaaaccaaccacggatgcgtcaggttttcgagcttcttctatcagcattgtgcagtactgcactgccttgttcattttgttagccttggccccgtgctggctcttgggccactgaa

SEQ ID NO: 10840 - DNA, 411 bp, Artificial
  TaSBEIIa allele with mutations introduced by TALEN pair TaSBEIIa_T03
gagagatagctggattaggcgatcgcctcaggccctggtgttaccacggctttgatcattcctcgtttcattctgatatatattttctcactctttttcttcctgttcttgctgtaactgcaagttgtggcgtttttcactattgtagtcatccttgcattttgcaggcgccgtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10841 - DNA, 398 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgacgacttggcaagtccggcgcaacctgaagaattacaggtacacacactcgtgccggtaaatcttcatacaatcgtattcacttaccaaatgccgatgaaaccacacggatgcgtcaggttcgagcttcttctatcagcattgtgcagtactgcactgccttgttcattttgttagccttggccccgtgctggctcttgggccactgaa

SEQ ID NO: 10842 - DNA, 478 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcgtcctggtgcctgacggcgagagcgacgacttggcaagtccggcgcaacctgaagaattacaggtacacacactcgtgccggtaaatcttacatacaatcgttaattcacttaccaaatgccggatgaaaccaaccacggatgcgtcaggtttcgagcttcttctatcagcattgtgcagtactgcactgccttgttctattttgttagtccttggccccgtgctggctcttgggccactgaa

SEQ ID NO: 10843 - DNA, 464 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctgcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgcctggctcttgggccactgaa

SEQ ID NO: 10844 - DNA, 483 bp, Artificial
  TaSBEIIa allele with mutations introduced by TALEN pair TaSBEIIa_T03
  misc_feature (413): n is a or c or t or g
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgngcagtactgcactgccttgttctattttgttagccttcggccccgtgctgggctcgttgggccacgtgaa

SEQ ID NO: 10845 - DNA, 435 bp, Artificial
  TaSBEIIa allele with mutations introduced by TALEN pair TaSBEIIa_T03
gagagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtccctggtgcctgacggtgagagcgacgacttggcgaccactccagcgcaacccgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10846 - DNA, 405 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcgttgggccactgaa

SEQ ID NO: 10847 - DNA, 420 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagcgagagcgacgacttggcaagtccggcgcaacctgaagaattacaggtacacacactcgtgccggtaaatcttcatacaatcgttattcacttaccaaatgccggatgaaaccaaccacggatgcgtcaggttttcgagcttcttctatcagcattgtgcagtactgcactgccttgttcattttgttagccttggccccgtgctggctcttgggccactgaa

SEQ ID NO: 10848 - DNA, 288 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatatttctcactctttcttctgttcttgctgtaactgtgtgccggaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10849 - DNA, 331 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10850 - DNA, 442 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccagggtcctggtgcctgacggtgagagcgacgacttggcaagtccggcgcaacctgaagaattacaggtacacaccatcgtgccgggaaatcttcatacaatcgttattcacttaccaaatgccggatgaaaccaaccacggatgcgtcaggtttcgagcttcttctatcagcattgtgcagtactgcactgccttgttcattttgttagccttggcccccgtgctggctcttgggccactgaa

SEQ ID NO: 10851 - DNA, 473 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgccctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggcccccgtgctggctcttgggccactgaa

SEQ ID NO: 10852 - DNA, 430 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccggaaggtcctggtgcctgacggtgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagtcttggccccgtgctggctcttgggccactgaa

SEQ ID NO: 10853 - DNA, 457 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctggtgcctgacggcgagagcgacgacttggcaagtccggcgcaacctgaagaattacaggtacacacactcgtgccggtaaatcttcatacaatcgttattcacttaccaaatgccggatgaaaccacacggatgcgtcaggtttcgagcttcttctatcagcattgtgcagtactgcactgccttgttcattttgttagccttggccccgtgctggctcttgggccactga

SEQ ID NO: 10854 - DNA, 460 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagtccttggccccgtgctggctcttgggccactgaa

SEQ ID NO: 10855 - DNA, 302 bp, Artificial; identical to SEQ ID NO: 10343
  TaSBEIIa allele with mutations introduced by TALEN pair TaSBEIIa_T03

SEQ ID NO: 10856 - DNA, 441 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccagggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttggccactgaa

SEQ ID NO: 10857 - DNA, 450 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagtccttggccccgtgctggctcttgggccactgaa

SEQ ID NO: 10858 - DNA, 367 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcaagtccggcgcaacctgaagaattacaggtacacaccatcgtgccgggaaatcttcatacaatcgttattcacttaccaaatgccggatgaaaccaaccacggatgcgtcaggtttcgagcttcttctatcagcattgtgcagtactgcactgccttgttcatttgttagccttggccccgtgctggctcttgggccactgaa

SEQ ID NO: 10859 - DNA, 435 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgacgacttggcaagtccggcgcaacctgaagaattacaggtacacacactcgtgccggtaaatcttcatacaatcgttattcacttaccaaatgccggatgaaaccaccacggatgcgtcaggttttcagcttcttctatcagcattgtgcagtactgcactgccttgttcattttgttagccttggccccgtgctggctcttgggccactgaa

SEQ ID NO: 10860 - DNA, 402 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatatttctcactctttcttctgttcttgctgtaactgcaagttgtagcattgtctcactattgtagtcatccttgcattgcaggcgccgtcctgagccgcgcggcctctccaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10861 - DNA, 455 bp, Artificial; identical to SEQ ID NO: 10157
  TaSBEIIa allele with mutations introduced by TALEN pair TaSBEIIa_T03

SEQ ID NO: 10862 - DNA, 437 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcagcaagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttctctatcagcattgtgcagtactgcactgccttgttcattttgttagccttggccccgtgctggctcttgggccactgaa

SEQ ID NO: 10863 - DNA, 476 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcccctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgtgcattttgttagccgtggccccgtgctggctcttgggccactgaa

SEQ ID NO: 10864 - DNA, 474 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggtcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 10865 - DNA, 378 bp, Artificial; identical to SEQ ID NO: 10301
  TaSBEIIa allele with mutations introduced by TALEN pair TaSBEIIa_T03

SEQ ID NO: 10866 - DNA, 424 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgtagccgtggccccgtgctggctcgttgggccactgaa

SEQ ID NO: 10867 - DNA, 406 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10868 - DNA, 472 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggttcgagcttcttctatcagcattgtgcagtactgcactgccttgttcattttgttagccttggccccgtgctggctcttgggccactgaa

SEQ ID NO: 10869 - DNA, 405 bp, Artificial
  TaSBEIIa allele with mutations introduced by TALEN pair TaSBEIIa_T03
gagagatagctggattaggcgatcgcctgcgtcagtgtcacccaggccctggtattatcacggctttgatcatctcctcccattctgatattttctcactctttcttctgttcttgctgtaactgcaagttgtagcattgtctcactattgtagtcatccttgcattgcaggcgccgtcctgagccgcgcgacgacttggcaagtccggcgcaacctgaagaattacaggtacacaccatcgtgccgggaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggccactgaa

SEQ ID NO: 10870 - DNA, 391 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgttggccccgtgctggctcttggggccactgaa

SEQ ID NO: 10871 - DNA, 406 bp, Artificial; identical to SEQ ID NO: 9887
  TaSBEIIa allele with mutations introduced by TALEN pair TaSBEIIa_T03

SEQ ID NO: 10872 - DNA, 479 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggcctgacggcgagagcgacgacttggcaagtccggcgcaacctgaagaattacaggtacacacactcgtgccggtaaatcttcatacaatcgttattcacttaccaaatgccggatgaaaaccaaccacggatgcgtcaggtttcgagcttcttctatcagcattgtgcagtactgcactgccttgttcattttgttagccttggccccgtgctggctcttgggccactgaa

SEQ ID NO: 10873 - DNA, 399 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtagcattgtctcactattgtagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10874 - DNA, 405 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggccacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttgttagccgtggccccgtgctggctcttgggccactgaa

SEQ ID NO: 10875 - DNA, 431 bp, Artificial; identical to SEQ ID NO: 10179
  TaSBEIIa allele with mutations introduced by TALEN pair TaSBEIIa_T03

SEQ ID NO: 10876 - DNA, 420 bp, Artificial
  TaSBEIIa allele with mutations introduced by TALEN pair TaSBEIIa_T03
gagagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcgacttggcggccactccagcgcaacccgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 10877 - DNA, 481 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcgggaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgcctggctcttgggccactgaa

SEQ ID NO: 10878 - DNA, 418 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcatttggcaagtccggcgcaacctgaagaattacaggtacacacactcgtgccggtaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 10879 - DNA, 262 bp, Artificial; identical to SEQ ID NO: 9893
  TaSBEIIa allele with mutations introduced by TALEN pair TaSBEIIa_T03

SEQ ID NO: 10880 - DNA, 473 bp, Artificial; identical to SEQ ID NO: 9264
  TaSBEIIa allele with mutations introduced by TALEN pair TaSBEIIa_T03

SEQ ID NO: 10881 - DNA, 479 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgcctttgttctattttgttagccttggccccgtgctggctcttgggccactgaa

SEQ ID NO: 10882 - DNA, 328 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcaacctgaagaattacaggtacacaccatcgtgccgggaaatcttcatacaatcgttattcacttaccaaatgccggatgaaaccaagccgcggaggcgtcaggtttgagcttcttctatcagcattgtgcagtactgcactgccttgtgcattttgtagccgtggccccgtgctggctcttgggccactgaa

SEQ ID NO: 10883 - DNA, 444 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgttagccggtggccccgtgctggctcgttgggccactgaa

SEQ ID NO: 10884 - DNA, 374 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactga

SEQ ID NO: 10885 - DNA, 479 bp, Artificial
  TaSBEIIa allele with mutations introduced by TALEN pair TaSBEIIa_T03
gagagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatcctttgcattttgcaggcgccgtcctgagcgggaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgcctttgttctattttgttagtccttggccccgtgctggctcttgggccactga

SEQ ID NO: 10886 - DNA, 298 bp, Artificial
  TaSBEIIa allele with mutations introduced by TALEN pair TaSBEIIa_T03
gagagatagctggattaggcgatcgcgcttcctgaacctgtattttttcccgcggggaaatgcgttagtgtcacccaggccctggtgttatcacggctttgatcatctcctcccattctgatattttctcactctttcttctgttcttgctgtaactgcaagttgtagcattgtctcactattgtagtcatccgcggaggcgtcaggttttgagcttcttctatcagcattgtgcagtactgcactgccttgtgcattttgttagccgtggccccgtgctggctcttgggccactgaa

SEQ ID NO: 10887 - DNA, 453 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcagcttcttctatcagcattgtgcagtactgcactgccttgttcattttgttagccttggccccgtgctggctcttgggccactgaa

SEQ ID NO: 10888 - DNA, 464 bp, Artificial; identical to SEQ ID NO: 10843
  TaSBEIIa allele with mutations introduced by TALEN pair TaSBEIIa_T03

SEQ ID NO: 10889 - DNA, 476 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggtcctggtgcctgacggcgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10890 - DNA, 449 bp, Artificial; identical to SEQ ID NO: 10033
  TaSBEIIa allele with mutations introduced by TALEN pair TaSBEIIa_T03

SEQ ID NO: 10891 - DNA, 442 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10892 - DNA, 453 bp, Artificial
  TaSBEIIa allele with mutations introduced by TALEN pair TaSBEIIa_T03
gagagatagctggattaggcgatcgcgcttcctgaacctgtatttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 10893 - DNA, 479 bp, Artificial; identical to SEQ ID NO: 9018
  TaSBEIIa allele with mutations introduced by TALEN pair TaSBEIIa_T03

SEQ ID NO: 10894 - DNA, 431 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccatgaa

SEQ ID NO: 10895 - DNA, 477 bp, Artificial; identical to SEQ ID NO: 10171
  TaSBEIIa allele with mutations introduced by TALEN pair TaSBEIIa_T03

SEQ ID NO: 10896 - DNA, 425 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggtttgagcttcttctatcagcattgtgcagtactgcactgccttgtgctattttgttagccgtggcccccgtgctggctcgttgggccactgaa

SEQ ID NO: 10897 - DNA, 453 bp, Artificial; identical to SEQ ID NO: 10389
  TaSBEIIa allele with mutations introduced by TALEN pair TaSBEIIa_T03

SEQ ID NO: 10898 - DNA, 416 bp, Artificial
  TaSBEIIa allele with mutations introduced by TALEN pair TaSBEIIa_T03
gagagatagctggattaggcgatcgcctcaggccctggtgttaccacggctttgatcatctcctcctttcatgctgatattttctcactctttcttctgttcttgctgtaactgcaagttgtggcgttttttcactattgtagtcatccttgcattttgcaggcgccgtcctgagccgcgcggcctcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10899 - DNA, 330 bp, Artificial
  TaSBEIIa allele with mutations introduced by TALEN pair TaSBEIIa_T03
  misc_feature (309): n is a or c or t or g
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcaaatcttcatacaatcgttattcacttaccaaatgccggatgaaaccaagccgcggaggcatcaggtttcaagcttcttctatcagcattgtgcactacttcactgccttgtgcagtttgttagctgtggccccgngctggctcttgggccactgaa

SEQ ID NO: 10900 - DNA, 472 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcgctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10901 - DNA, 432 bp, Artificial; identical to SEQ ID NO: 10823
  TaSBEIIa allele with mutations introduced by TALEN pair TaSBEIIa_T03

SEQ ID NO: 10902 - DNA, 478 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagccttggccccgtgctggctcttgggccactgaa

SEQ ID NO: 10903 - DNA, 426 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggtttgagcttcttctatcagcattgtgcagtactgcactgccttgtgctattttgtagccgtggccccgtgctggctcgttgggccatgaa

SEQ ID NO: 10904 - DNA, 465 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 10905 - DNA, 480 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgacgtcaggtttcgagcttcttctatcagcattgtgcagtactgcactgccttgttcattttgttagccttggccccgtgctggctcttgggccactgaa

SEQ ID NO: 10906 - DNA, 397 bp, Artificial; identical to SEQ ID NO: 10615
  TaSBEIIa allele with mutations introduced by TALEN pair TaSBEIIa_T03

SEQ ID NO: 10907 - DNA, 275 bp, Artificial
  TaSBEIIa allele with mutations introduced by TALEN pair TaSBEIIa_T03
gagagatagctggattaggcgatcgcctgcgtcagtgtcacccaggccccggtgttaccacggctttgatcatctcctcctttcatgctgatattttctcactctttcttctgttcttgctgtaactgcaagttgtagcatttcttaccaaatatcggatgaaccaagccgcggaggcatcaggtttcaagcttcttctatcagcattgtgcactacttcactgccttgtgcagtttgttagctgtggccccgcgctggctcttgggccactgaa

SEQ ID NO: 10908 - DNA, 424 bp, Artificial; identical to SEQ ID NO: 10766
  TaSBEIIa allele with mutations introduced by TALEN pair TaSBEIIa_T03

SEQ ID NO: 10909 - DNA, 473 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcgcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10910 - DNA, 313 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaaattacaggtacacaccatcgtgccgggaaatcttcatacaatcgttaattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10911 - DNA, 385 bp, Artificial
  TaSBEIIa allele with mutations introduced by TALEN pair TaSBEIIa_T03
gagagatagctggattaggcgatcgcgcttcctgaacctgttattttttccccgcggggaaatgcgttagtgtcacccaggccctggtgttaccacggctttgatcattcctcgtttcattctgatatatattttctcactctttttcttcctgttcttgctgtaactgcaagttgttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10912 - DNA, 248 bp, Artificial
  TaSBEIIa allele with mutations introduced by TALEN pair TaSBEIIa_T03
gagagtagctggattaggcgatcgcctgcgtcagtgtcacccaggccctggtgttatcacggctttgatcatctcctcccattctgatattttctcactctttcttctgttcttgcttaccaatgccggatgaaaccaagccgcggaggcgtcaggttttgagcttcttctatcagcattgtgcagtactgcactgccttgtgctattttgttagccgtggccccgtgctggctcttgggccactgaa

SEQ ID NO: 10913 - DNA, 470 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagccttggccccgtgctggctcttgggccactgaa

SEQ ID NO: 10914 - DNA, 390 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgtagccgtggccccgtgctggctcttgggccactgaa

SEQ ID NO: 10915 - DNA, 430 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcgcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgcctggctcttgggccactgaa

SEQ ID NO: 10916 - DNA, 364 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcacggcgcaacctgaagaattacaggtacacaccatcgtgccgggaaatcttcatacaatcgttattcacttaccaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10917 - DNA, 331 bp, Artificial; identical to SEQ ID NO: 10849
  TaSBEIIa allele with mutations introduced by TALEN pair TaSBEIIa_T03

SEQ ID NO: 10918 - DNA, 467 bp, Artificial; identical to SEQ ID NO: 9077
  TaSBEIIa allele with mutations introduced by TALEN pair TaSBEIIa_T03

SEQ ID NO: 10919 - DNA, 252 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccaccatcgtgccgggaaatcttcatacaatcgttattcacttaccaaatgccggatgaaaccaagccgcggaggcgtcaggttttgagcttcttctatcagcattgtgcagtactgcactgccttgtgctattttgttagccgtggcccgtgctggctcttgggccactgaa

SEQ ID NO: 10920 - DNA, 416 bp, Artificial; identical to SEQ ID NO: 9823
  TaSBEIIa allele with mutations introduced by TALEN pair TaSBEIIa_T03

SEQ ID NO: 10921 - DNA, 414 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgcggtcctggtgcctgacggtgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggcccgtgctggctcttgggccactgaa

SEQ ID NO: 10922 - DNA, 421 bp, Artificial
  TaSBEIIa allele with mutations introduced by TALEN pair TaSBEIIa_T03
gagagatagctggattaggcgatcgcctgcgtcagtgtcaccccaggccctggtgttatcacggctttgatcatctcctcccattctgatattttctcactctttcttctgttcttgctgtaactgcaagttgtagcattgtctcactattgtagtcatccttgcattgcaggtgccgtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggcccccgtgcctggctcgttggggccactgaa

SEQ ID NO: 10923 - DNA, 441 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgtagccgtggccccgtgctggctcttgggccactgaa

SEQ ID NO: 10924 - DNA, 432 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccggaaggtcctggtgcctgacggtgagagcgacgacttggcaagtccggcgcaacctgaagaattacaggtacacacactcgtgccggtaaatcttcatacatcgttattcacttaccaaatgccggatgaaaccaaccacggatgcgtcaggtttcgagcttcttctatcagcattgtgcagtactgcactgccttgttctattttgttagtccttggccccgtgctggctcgttgggccactgaa

SEQ ID NO: 10925 - DNA, 461 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 10926 - DNA, 418 bp, Artificial
  TaSBEIIa allele with mutations introduced by TALEN pair TaSBEIIa_T03
gagagatagctggattaggcgatcgcctcaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttctctatcagcattgtgcagtactgcactgccttgttcattttgtagccttggccccgtgctggctcttgggccactgaa

SEQ ID NO: 10927 - DNA, 478 bp, Artificial
  TaSBEIIa allele with mutations introduced by TALEN pair TaSBEIIa_T03
  misc_feature (421): n is a or c or t or g
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtacngcactgccttgttcattttgttagccttggccccgtgctggctcttgggccactgaa

SEQ ID NO: 10928 - DNA, 381 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 10929 - DNA, 431 bp, Artificial; identical to SEQ ID NO: 9914
  TaSBEIIa allele with mutations introduced by TALEN pair TaSBEIIa_T03

SEQ ID NO: 10930 - DNA, 454 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcgagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10931 - DNA, 460 bp, Artificial; identical to SEQ ID NO: 10134
  TaSBEIIa allele with mutations introduced by TALEN pair TaSBEIIa_T03

SEQ ID NO: 10932 - DNA, 453 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgtagccttggccccgtgctggctcttgggccactgaa

SEQ ID NO: 10933 - DNA, 475 bp, Artificial; identical to SEQ ID NO: 10305
  TaSBEIIa allele with mutations introduced by TALEN pair TaSBEIIa_T03

SEQ ID NO: 10934 - DNA, 478 bp, Artificial
  TaSBEIIa allele with mutations introduced by TALEN pair TaSBEIIa_T03
gagagatagctggattaggcgatcgcgcttcctgaacctgttattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10935 - DNA, 442 bp, Artificial; identical to SEQ ID NO: 10017
  TaSBEIIa allele with mutations introduced by TALEN pair TaSBEIIa_T03

SEQ ID NO: 10936 - DNA, 470 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10937 - DNA, 463 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgttcccggtgcctgacggcgagagcgacgacttggcaagtccggcgcaacctgaagaattacaggtacacacactcgtgccggtaaaatcttcatacaattcgttattcacttaccaaatgccggatgaaaccaaccacggatgcgtcaggttttcgagcttcttctatcagcattgtgcagtactgcactgccttgttcattttgtagccttggccccgtgctggctcttgggccactgaa

SEQ ID NO: 10938 - DNA, 480 bp, Artificial
  TaSBEIIa allele with mutations introduced by TALEN pair TaSBEIIa_T03
gagagatagctggattaggcgatcgcgcttcctgaacctgttattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcgggaaggtcctggtgcctgacggcgagagcgacgacttggcaagtccggcgcaacctgaagaattacaggtacacacactcgtgccggtaaatcttcatacaatcgttattcacttacaatgccggatgaaaccaaccacggatgcgtcaggtttcgagcttcttctatcagcattgtgcagtactgcactgccttgttctattttgttagccttggccccgtgctggctcttgggccactgaa

SEQ ID NO: 10939 - DNA, 443 bp, Artificial; identical to SEQ ID NO: 10349
  TaSBEIIa allele with mutations introduced by TALEN pair TaSBEIIa_T03

SEQ ID NO: 10940 - DNA, 454 bp, Artificial; identical to SEQ ID NO: 10930
  TaSBEIIa allele with mutations introduced by TALEN pair TaSBEIIa_T03

SEQ ID NO: 10941 - DNA, 196 bp, Artificial; identical to SEQ ID NO: 9801
  TaSBEIIa allele with mutations introduced by TALEN pair TaSBEIIa_T03

SEQ ID NO: 10942 - DNA, 460 bp, Artificial; identical to SEQ ID NO: 10134
  TaSBEIIa allele with mutations introduced by TALEN pair TaSBEIIa_T03

SEQ ID NO: 10943 - DNA, 477 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcggtcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 10944 - DNA, 478 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgcctggctcttgggccactgaa

SEQ ID NO: 10945 - DNA, 463 bp, Artificial; identical to SEQ ID NO: 10729
  TaSBEIIa allele with mutations introduced by TALEN pair TaSBEIIa_T03

SEQ ID NO: 10946 - DNA, 456 bp, Artificial
  TaSBEIIa allele with mutations introduced by TALEN pair TaSBEIIa_T03
gagagatagctggattaggcgatcgcgcttcctgaacctgtattttttcccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgccaggtttcgagcttcttctatcagcattgtgcagtactgcactgccttgttcattttgttagccttggccccgtgctggctcttgggccactgaa

SEQ ID NO: 10947 - DNA, 459 bp, Artificial
  TaSBEIIa allele with mutations introduced by TALEN pair TaSBEIIa_T03
gagagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaggtcctggtgcctgacggtgagagcgacgacttggcggccactccagcgcaacccgaagaattacaggtacacaccgtcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10948 - DNA, 484 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcgggggaaggtcctggtgcctgacggcgagagcgacgacttggcaagtccggcgcaacctgaagaattacaggtacacacactcgtgccggtaaatcttcatacaatcgtattcacttaccaaatgccggatgaaaccaaccacggatgcgtcaggtttcgagcttcttctatcagcattgtgcagtactgcactgccttgttcattttgttagcctttggcccccgtgcctggctcttgggccactgaa

SEQ ID NO: 10949 - DNA, 476 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgtgcattttgttagccgtggccccgtgctgactcttgggccactgaa

SEQ ID NO: 10950 - DNA, 349 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatcctgaagaattacaggtacacaccatcgtgccgggaaatcttcatacaatcgttattcacttaccaaatgccggatgaaaccaagccgcggaggcgtcaggtttgagcttcttctatcagcattgtgcagtactgcactgccttgtgcattttgttagccgtggccccgtgctggctcttgggccactgaa

SEQ ID NO: 10951 - DNA, 436 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgagtccggcgcaacctgaagaattacaggtacacacactcgtgccggtaaatcttcatacaatcgttattcacttaccaaatgccggatgaaaccaaccacggatgcgtcaggttttcgagcttcttctatcagcattgtgcagtactgcactgccttgttcattttgttagccttggccccgtgctggctcttgggccactgaa

SEQ ID NO: 10952 - DNA, 468 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagtccttggccccgtgctggctcttgggccactgaa

SEQ ID NO: 10953 - DNA, 460 bp, Artificial; identical to SEQ ID NO: 10134
  TaSBEIIa allele with mutations introduced by TALEN pair TaSBEIIa_T03

SEQ ID NO: 10954 - DNA, 390 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtgggccccgtgctggctcttgggccactgaa

SEQ ID NO: 10955 - DNA, 471 bp, Artificial; identical to SEQ ID NO: 9990
  TaSBEIIa allele with mutations introduced by TALEN pair TaSBEIIa_T03

SEQ ID NO: 10956 - DNA, 436 bp, Artificial; identical to SEQ ID NO: 10626
  TaSBEIIa allele with mutations introduced by TALEN pair TaSBEIIa_T03

SEQ ID NO: 10957 - DNA, 394 bp, Artificial
  TaSBEIIa allele with mutations introduced by TALEN pair TaSBEIIa_T03
gagagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtccagcgcaacccgaagaattacaggtacacaccgtcgtgccggaaaatcttcatgcacccgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10958 - DNA, 465 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttctattttgttagccttggccccgtgctggctcgttgggccactgaa

SEQ ID NO: 10959 - DNA, 406 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcagggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10960 - DNA, 479 bp, Artificial; identical to SEQ ID NO: 9018
  TaSBEIIa allele with mutations introduced by TALEN pair TaSBEIIa_T03

SEQ ID NO: 10961 - DNA, 429 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtccagtccggcgcaacctgaagaattacaggtacacacactcgtgccggtaaatcttcatacaatcgttattcacttaccaaatgccggatgaaaccaaccacggatgcgtcaggttttcgagcttcttctatcagcattgtgcagtactgcactgccttgttcattttgttagccttggccccgtgctggctcttgggccactgaa

SEQ ID NO: 10962 - DNA, 400 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaaggtgtagcattgtctcactattgtagtcatccttgcattgcaggcgcggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10963 - DNA, 464 bp, Artificial
  TaSBEIIa allele with mutations introduced by TALEN pair TaSBEIIa_T03
gagagatagctggattaggcgatcgcgcttcctgaacctgttattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcctgacggcgagagcgacgacttggcaagtccggcgcaacctgaagaattacaggtacacacactcgtgccggtaaatcttcatacaatcgttattcacttaccaaatgccggatgaaacccacacggatgcgtcaggtttcgagcttcttctatcagcattgtgcagtactgcactgccttgttcattttgttagccttggccccgtgctggctcttgggccactgaa

SEQ ID NO: 10964 - DNA, 476 bp, Artificial
  TaSBEIIa allele with mutations introduced by TALEN pair TaSBEIIa_T03
gagagatagctggattaggcgatcgcgcttcctgaacctgtattttttcccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtacctgcactgccttgttcattttgtagccttggccccgtgctggctcttgggccactgaa

SEQ ID NO: 10965 - DNA, 436 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcgggaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgtagccgtggccccgtgctggctcttgggccactgaa

SEQ ID NO: 10966 - DNA, 384 bp, Artificial
  TaSBEIIa allele with mutations introduced by TALEN pair TaSBEIIa_T03
gagagatagctggattaggcgatcgcctgcgtcagtgtcacccaggccctggtgttaccacggctttgatcattcctcgtttcattctgatatatattttctcactcttttcttcctgttcttgctgtaactgcaagttgtggcgttttttcactattgtagtcatccttgcattttgcaaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10967 - DNA, 460 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgtgcctgacggcgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10968 - DNA, 464 bp, Artificial; identical to SEQ ID NO: 10704
  TaSBEIIa allele with mutations introduced by TALEN pair TaSBEIIa_T03

SEQ ID NO: 10969 - DNA, 448 bp, Artificial
  TaSBEIIa allele with mutations introduced by TALEN pair TaSBEIIa_T03
gagagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 10970 - DNA, 481 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggggaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10971 - DNA, 458 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttcatcagcattgtgcagtactgcactgccttgttcattttgttagccttggccccgtgctggctcttgggccactgaa

SEQ ID NO: 10972 - DNA, 396 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcgttgggccactgaa

SEQ ID NO: 10973 - DNA, 433 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgatggctcttgggccactgaa

SEQ ID NO: 10974 - DNA, 460 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcatttgttagccttggccccgtgctggctcttgggccactgaa

SEQ ID NO: 10975 - DNA, 265 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactga

SEQ ID NO: 10976 - DNA, 480 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctgtcctggtgcctgacggcgagagcgacgacttggcaagtccggcgcaacctgaagaattacaggtacacacactcgtgccggtaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 10977 - DNA, 474 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctcgtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10978 - DNA, 472 bp, Artificial
  TaSBEIIa allele with mutations introduced by TALEN pair TaSBEIIa_T03
gagagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggcgagagcgacgacttggcaagtccggcgcaacctgaagaattacaggtacacacactcgtgccggtaaatcttcatacaatcgttattcacttaccaaatgccggatgaaaaccaaccacggatgcgtcaggtttcgagcttcttctatcagcattgtgcagtactgcactgccttgttcattttgttagccttggccccgtgctggctcttgggccactgaa

SEQ ID NO: 10979 - DNA, 437 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10980 - DNA, 440 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccagggtcctggtgcctgacggtgagagcgacgacttggcaagtccggcgcaacctgaagaattacaggtacacaccatcgtgccgggaaatcttcatacaatcgttattcacttaccaatgccggatgaaaccaagccgcggaggcgtcaggtttgagcttcttctatcagcattgtgcagtactgcactgccttgtgctattttgtagccgtggccccgtgctggctcttgggccactgaa

SEQ ID NO: 10981 - DNA, 466 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttctctatcagcattgtgcagtactgcactgccttgttcattttgttagccttggccccgtgctggctcttgggccactgaa

SEQ ID NO: 10982 - DNA, 446 bp, Artificial
  TaSBEIIa allele with mutations introduced by TALEN pair TaSBEIIa_T03
gagagatagctggattaggcgatcgcctcaggccctggtgttaccacggctttgatcatctcctcctttcatgctgatattttctcactctttcttctgttcttgctgtaactgcaagttgtagctatttttttggcaaataagttgtagcattgtctcagtattgtactcatccttgcattgcaggcgccgtcctgagccgcgcggcctggtgcctgacggtgagagcgacgacttggcaagtccggcgcaacctgaagaattacaggtacacaccatcgtgccgggaaatcttcatacaatcgttattcacttaccaaatgccggatgaaaaccaagccgcggaggcgtcaggttttgagcttcttctatcagcattgtgcagtactgcactgccttgtgcattttgttagccgtggccccgtgctggctcttgggccactgaa

SEQ ID NO: 10983 - DNA, 467 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcgcctgacggcgagagcgacgacttggcaagtccggcgcaacctgaagaattacaggtacacaccatcgtgccgggaaatcttcatacaatcgttattcacttaccaaatgccggatgaaaaccaagccgcggaggcgtcaggtttgagcttcttctatcagcattgtgcagtactgcactgccttgtgcattttgttagccgtggccccgtgctggctcttgggccactgaa

SEQ ID NO: 10984 - DNA, 441 bp, Artificial; identical to SEQ ID NO: 10322
  TaSBEIIa allele with mutations introduced by TALEN pair TaSBEIIa_T03

SEQ ID NO: 10985 - DNA, 476 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggccctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgcctggctcttgggccactgaa

SEQ ID NO: 10986 - DNA, 475 bp, Artificial; identical to SEQ ID NO: 10305
  TaSBEIIa allele with mutations introduced by TALEN pair TaSBEIIa_T03

SEQ ID NO: 10987 - DNA, 442 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccagggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccacgtgaa

SEQ ID NO: 10988 - DNA, 424 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcgtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagtccttggccccgtgctggctcttgggccactgaa

SEQ ID NO: 10989 - DNA, 445 bp, Artificial
  TaSBEIIa allele with mutations introduced by TALEN pair TaSBEIIa_T03
gagagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcattgcaggcgccgtcctgagccgcgcggcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcactacttcactgccttgtgcagtttgttagctgtggcccccgcgctggctcttgggccactgaa

SEQ ID NO: 10990 - DNA, 478 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggttcgagcttcttctatcagcattgtgcagtactgcactgccttgttcattttgttagccttggccccgtgctggctcttgggccactgaa

SEQ ID NO: 10991 - DNA, 429 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattttgcaggcgccgtcctgagccgcgcggccctggtgcctgacggcgagagcgacgacttggcaagtccggcgcaacctgaagaattacaggtacacacactcgtgccggtaaatcttcatacaatcgttattcacttaccaaatgccgatgaaaccacacggatgcgtcaggtttcgagcttcttctatcagcattgtgcagtactgcactgccttgttcattttgttagccttggccccgtgctggctcttgggccactgaa

SEQ ID NO: 10992 - DNA, 452 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10993 - DNA, 471 bp, Artificial; identical to SEQ ID NO: 9391
  TaSBEIIa allele with mutations introduced by TALEN pair TaSBEIIa_T03

SEQ ID NO: 10994 - DNA, 383 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 10995 - DNA, 284 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtatcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 10996 - DNA, 375 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgttagccgtggccccgtgctggctcgttggggccactgaa

SEQ ID NO: 10997 - DNA, 417 bp, Artificial
  TaSBEIIa allele with mutations introduced by TALEN pair TaSBEIIa_T03
  misc_feature (372): n is a or c or t or g
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctggtgcctgacggtgagagcgacgacttggcaagtccggcgcaacctgaagaattacaggtacacaccatcgtgccgggaaatcttcatacaatcgttaattcacttaccaaatgccggatgaaaccaagccgcggaggcgtcaggttttgagcttcttctatcagcattgtgcagtactgcactgccttgngcattttgtagccgtggccccgttgctggctcttgggccactgaa

SEQ ID NO: 10998 - DNA, 263 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcaaatgccggatgaaaccaagccgcggaggcgtcaggtttgagcttcttctatcagcattgtgcagtactgcactgccttgtgctattttgttagccgtggccccgtgctggctcttgggccactgaa

SEQ ID NO: 10999 - DNA, 378 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 11000 - DNA, 431 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctgggctcttgggccactgaa

SEQ ID NO: 11001 - DNA, 382 bp, Artificial; identical to SEQ ID NO: 10595
  TaSBEIIa allele with mutations introduced by TALEN pair TaSBEIIa_T03

SEQ ID NO: 11002 - DNA, 422 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcaacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 11003 - DNA, 454 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcatttgttagccttggccccgtgctggctcttgggccactgaa

SEQ ID NO: 11004 - DNA, 433 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcgggaaggtcctggtgcctgacggtgagagcgacgacttggcaagtccggcgcaacctgaagaattacaggtacacaccatcgtgccgggaatcttcatacaatcgttattcacttaccaaatgccggatgaaaccaagccgcggaggcgtcaggttttgagcttcttctatcagcattgtgcagtactgcactgccttgtgcatttttgtagccgtggccccgtgctggctcttgggccatga

SEQ ID NO: 11005 - DNA, 482 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgtagccgtagtcccggtccgtcgtcggtcgtccttcgggtccggacctagtacgtacgtaggacgtcgtcgaacggacgaccacacgggaggtaag

SEQ ID NO: 11006 - DNA, 370 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 11007 - DNA, 450 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcagcttcttctatcagcattgtgcagtactgcactgccttgttcattttgttagccttggccccgtgctggctcttgggccactgaa

SEQ ID NO: 11008 - DNA, 454 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 11009 - DNA, 461 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgcggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggttttcgagcttcttctatcagcattgtgcagtactgcactgccttgttcattttgttagccttggccccgtgctggctcttgggccactgaa

SEQ ID NO: 11010 - DNA, 463 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 11011 - DNA, 439 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 11012 - DNA, 423 bp, Artificial; identical to SEQ ID NO: 10280
  TaSBEIIa allele with mutations introduced by TALEN pair TaSBEIIa_T03

SEQ ID NO: 11013 - DNA, 411 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagcggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgttggccccgtgctggctcttgggccactgaa

SEQ ID NO: 11014 - DNA, 470 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagtccttggccccgtgctggctcttgggccactgaa

SEQ ID NO: 11015 - DNA, 475 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcgttgggccactgaa

SEQ ID NO: 11016 - DNA, 445 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgacttggcaagtccggcgcaacctgaagaattacaggtacacacactcgtgccggtaaatcttcatacaatcgttattcacttaccaaatgccggatgaaaccaaccacggatgcgtcaggtttcgagcttctctatcagcattgtgcagtactgcactgccttgttcattttgttagccttggccccgtgcctggctcttgggccactgaa

SEQ ID NO: 11017 - DNA, 433 bp, Artificial
  TaSBEIIa allele with mutations introduced by TALEN pair TaSBEIIa_T03
  misc_feature (410): n is a or c or t or g
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcatttgcaggcgccgtcctgaggtcctggtgcctgacggtgagagcgacgacttggcggccactccagcgcaacccgaagaattacaggtacacaccgtcgtgaccggaaaatcttcatgcacccgttattcacttaccaaatatcggatgaaccaagccgcggaggcatcaggtttcaagtcttcttctatcagcattgtgcactacttcactgccttgtgctagtttgttagctgtcggccccgngctggctcgttgggccacgtgaa

SEQ ID NO: 11018 - DNA, 398 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 11019 - DNA, 467 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgtagtccttggccccgtgctggctcttgggccactgaa

SEQ ID NO: 11020 - DNA, 467 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttctctatcagcattgtgcagtactgcactgccttgttcattttgttagccttggccccgtgctggctcgttgggccactgaa

SEQ ID NO: 11021 - DNA, 348 bp, Artificial
  TaSBEIIa allele with mutations introduced by TALEN pair TaSBEIIa_T03
gagagatagctggattaggcgatcgcctgcgtcagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 11022 - DNA, 471 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgcctggctcttgggccactgaa

SEQ ID NO: 11023 - DNA, 459 bp, Artificial
  TaSBEIIa allele with mutations introduced by TALEN pair TaSBEIIa_T03
  misc_feature (219): n is a or c or t or g
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcnccgtcctgagccgcgcggccagagcgacgacttggcaagtccggcgcaacctgaagaattacaggtacacacactcgtgccggtaaatcttcatacaatcgttattcacttaccaaatgccggatgaaaccaaccacggatgcgtcaggttttcgagcttcttctatcagcattgtgcagtactgcactgccttgttcattttgtagccttggccccgtgctggctcttgggccactgaa

SEQ ID NO: 11024 - DNA, 460 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcgagagcgacgacttggcaagtccggcgcaacctgaagaattacaggtacacacactcgtgccggtaaatcttcatacaatcgttatcacttaccaaatgccggatgaaaccaccacggatgcgtcaggtttcgagtcttcttctatcagcattgtgcagtactgcactgccttgttcattttgttagccttggccccgtgctgggctcgttgggccactgaa

SEQ ID NO: 11025 - DNA, 437 bp, Artificial
  TaSBEIIa allele with mutations introduced by TALEN pair TaSBEIIa_T03
gagagatagctggattaggcgatcgcgcttcctgaacctgtattttttcccgcggggaaatgcgttagtgtcacccaggccctggtgttaaccacggctttgatcattcctcgtttcattctgatatatattttctcactctttttcttcctgttcttgctgtaactgcaagttgtggcgttttttcactattgtagtcatccttgcattttgcaggcgccgtcgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctgggctcttgggccactgaa

SEQ ID NO: 11026 - DNA, 403 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcgttgggccactgaa

SEQ ID NO: 11027 - DNA, 424 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctccccattctgatattttctcactctttcttctgttcttgctgtaactgcaagttgtagcattgtctcactattgtagtcatccttgcattgcaggcgccgtcctgagccgcgcggcctgacggtgagagcgacgacttggcaagtccggcgcaacctgaagaattacaggtacacaccatcgtgccgggaaatcttcatacaatcgttattcacttacaaatgccggatgaaaccaagccgacggaggcgtcaggtttgagcttcttctatcagcattgtgcagtactgcactgccttgtgctattttgttagccgtggccccgtgctggctcttgggccactgaa

SEQ ID NO: 11028 - DNA, 372 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgttagccgtggccccgtgctggctctgggccactga

SEQ ID NO: 11029 - DNA, 474 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcagggttttcgagcttcttctatcagcattgtgcagtactgcactgccttgttcattttgttagccttggccccgtgctggctcttgggccactgaa

SEQ ID NO: 11030 - DNA, 472 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgggtcctggtgcctgacggcgagagcgacgacttggcaagtccggcgcaacctgaagaattacaggtacacacactcgtgccggtaaatcttcatacaatcgttatcacttaccaaatgccggatgaaaccaccacggatgcgtcaggtttcgagcttcttctatcagcattgtgcagtactgcactgccttgttctattttgttagtccttggccccgtgctggctcttgggccactgaa

SEQ ID NO: 11031 - DNA, 476 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggccctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagccttggccccgtgctggctcttgggccactgaa

SEQ ID NO: 11032 - DNA, 427 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 11033 - DNA, 422 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccagggagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 11034 - DNA, 486 bp, Artificial; identical to SEQ ID NO: 8887
  TaSBEIIa allele with mutations introduced by TALEN pair TaSBEIIa_T03

SEQ ID NO: 11035 - DNA, 457 bp, Artificial
  TaSBEIIa allele with mutations introduced by TALEN pair TaSBEIIa_T03
gagagatagctggattaggcgatcgcgcttcctgaacctgtattttttccccgcgggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagcgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaaa

SEQ ID NO: 11036 - DNA, 473 bp, Artificial; identical to SEQ ID NO: 10054
  TaSBEIIa allele with mutations introduced by TALEN pair TaSBEIIa_T03

SEQ ID NO: 11037 - DNA, 454 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcggagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 11038 - DNA, 471 bp, Artificial
  TaSBEIIa allele with mutations introduced by TALEN pair TaSBEIIa_T03
gagagatagctggattaggcgatcgcgcttcctgaacctgtatttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcgctggtgcctgacggcgagagcgacgacttggcaagtccggcgcaacctgaagaattacaggtacacacactcgtgccggtaaatcttcatacaatcgttattcacttaccaaatgccggatgaaaaccaaccacggatgcgtcaggtttcgagcttcttctatcagcattgtgcagtactgcactgccttgttcattttgtagccttggccccgtgctggctcttgggccactgaa

SEQ ID NO: 11039 - DNA, 423 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcgggcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 11040 - DNA, 433 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagtccgtgggccccgtgcctgggctcttgggccatgaa

SEQ ID NO: 11041 - DNA, 338 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 11042 - DNA, 464 bp, Artificial
  TaSBEIIa allele with mutations introduced by TALEN pair TaSBEIIa_T03
gagagatagctggattaggcgatcgcgcttcctgaacctgtattttttcccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctaggtcctggtgcctgacggcgagagcgacgacttggcaagtccggcgcaacctgaagattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgtagccttggccccgtgctggctcttgggccactgaa

SEQ ID NO: 11043 - DNA, 477 bp, Artificial
  TaSBEIIa allele with mutations introduced by TALEN pair TaSBEIIa_T03
gagagatagctggattaggcgatcgcgcttcctgaacctgtattttttcccgtcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcccctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagccttggccccgtgctggctcttgggccactgaa

SEQ ID NO: 11044 - DNA, 251 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccaccatcgtgccgggaaatcttcatacaatcgttattcacttaccaaatgccggatgaaaccaagccgcggaggcgtcaggttttgagcttcttctatcagcattgtgcagtactgcactgccttgtgctattttgtagccgtggcccgtgctggctcttgggccactgaa

SEQ ID NO: 11045 - DNA, 454 bp, Artificial; identical to SEQ ID NO: 11008
  TaSBEIIa allele with mutations introduced by TALEN pair TaSBEIIa_T03

SEQ ID NO: 11046 - DNA, 408 bp, Artificial
  TaSBEIIa allele with mutations introduced by TALEN pair TaSBEIIa_T03
gagagatagctggattaggcgatcgcctcaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccagggagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 11047 - DNA, 430 bp, Artificial
  TaSBEIIa allele with mutations introduced by TALEN pair TaSBEIIa_T03
  misc_feature (418): n is a or c or t or g
gagagatagctggattaggcgatcgcctgcgtcagtgtcacccaggccttggtgttatcacggctttgatcatctcctcccattctgatattttctcactctttcttctgttcttgctgtaactgcaagttgtagcattgtctcactattgtagtcatccttgcattgcaggcgccgtcctgagccggaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctntgggccactgaa

SEQ ID NO: 11048 - DNA, 397 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 11049 - DNA, 430 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 11050 - DNA, 409 bp, Artificial
  TaSBEIIa allele with mutations introduced by TALEN pair TaSBEIIa_T03
  misc_feature (404): n is a or c or t or g
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagcggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccnctgaa

SEQ ID NO: 11051 - DNA, 426 bp, Artificial
  TaSBEIIa allele with mutations introduced by TALEN pair TaSBEIIa_T03
gagagatagctggattaggcgatcgcctcaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 11052 - DNA, 480 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagtcgtggcgttttttcactattgtagtcatccttgcattttgcaggcgccgtcctgagccgcgcgggaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 11053 - DNA, 247 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 11054 - DNA, 195 bp, Artificial; identical to SEQ ID NO: 9876
  TaSBEIIa allele with mutations introduced by TALEN pair TaSBEIIa_T03

SEQ ID NO: 11055 - DNA, 278 bp, Artificial; identical to SEQ ID NO: 10209
  TaSBEIIa allele with mutations introduced by TALEN pair TaSBEIIa_T03

SEQ ID NO: 11056 - DNA, 441 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcaagtccggcgcaacctgaagaattacaggtacacacactcgtgccggtaaatcttcatacaatcgttattcacttaccaaatgccggatgaaaaccaaccacggatgcgtcaggttttcagcttcttctatcagcattgtgccagtactgcactgccttgttcattttgttagccttggccccgtgctggctcttgggccactgaa

SEQ ID NO: 11057 - DNA, 418 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtccctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgttagccgtggccccgtgctggctcttgggccactgaa

SEQ ID NO: 11058 - DNA, 423 bp, Artificial
  TaSBEIIa allele with mutations introduced by TALEN pair TaSBEIIa_T03
gagagatagctggattaggcgatcgcctgcgtcagtgtcactcaggccctggtgttatcacggctttgatcatctcctcccattctgattattttctcactctttcttctgttcttgctgtaactgcaagttgtagcattgtctcactattgtagtcatccttgcattgcaggcgccgtcctgagccgcgcgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 11059 - DNA, 475 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggctcccggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttctctatcagcattgtgcagtactgcactgccttgttcattttgttagccttggccccgtgctggctcttgggccactgaa

SEQ ID NO: 11060 - DNA, 202 bp, Artificial; identical to SEQ ID NO: 9791
  TaSBEIIa allele with mutations introduced by TALEN pair TaSBEIIa_T03

SEQ ID NO: 11061 - DNA, 451 bp, Artificial
  TaSBEIIa allele with mutations introduced by TALEN pair TaSBEIIa_T03
gagagatagctggattaggcgatcgcgcttcctgaacctgtattttttcccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 11062 - DNA, 379 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 11063 - DNA, 226 bp, Artificial; identical to SEQ ID NO: 10207
  TaSBEIIa allele with mutations introduced by TALEN pair TaSBEIIa_T03

SEQ ID NO: 11064 - DNA, 476 bp, Artificial
  TaSBEIIa allele with mutations introduced by TALEN pair TaSBEIIa_T03
gagagatagctggattaggcgatcgcgcttcctgaacctgtattttttcccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcggtgcctgacggcgagagcgacgacttggcaagtccggcgcaacctgaagaattacaggtacacacactcgtgccggtaaatcttcatacaatcgttattcacttaccaaatgccggatgaaaaccaaccacggatgcgtcaggtttcgagcttcttctatcagcattgtgcagtactgcactgccttgttcattttgttagccttggccccgtgctggctcttgggccactga

SEQ ID NO: 11065 - DNA, 415 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctggtgcctgacggtgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 11066 - DNA, 195 bp, Artificial; identical to SEQ ID NO: 9805
  TaSBEIIa allele with mutations introduced by TALEN pair TaSBEIIa_T03

SEQ ID NO: 11067 - DNA, 464 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcctgacggcgagagcgacgacttggcaagtccggcgcaacctgaagaattacaggtacacacactcgtgccggtaaaatcttcatacaatcgttattcacttaccaaatgccggatgaaaaccaacacggatgcgtcaggtttcgagcttcttctatcagcattgtgcagtactgcactgccttgttcattttgtagccttggccccgtgctggctcttgggccactgaa

SEQ ID NO: 11068 - DNA, 415 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtccggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 11069 - DNA, 244 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatatttctcactctttcttctgttcttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 11070 - DNA, 386 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 11071 - DNA, 484 bp, Artificial; identical to SEQ ID NO: 9104
  TaSBEIIa allele with mutations introduced by TALEN pair TaSBEIIa_T03

SEQ ID NO: 11072 - DNA, 432 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctcggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcgttgggccacgtgaa

SEQ ID NO: 11073 - DNA, 405 bp, Artificial; identical to SEQ ID NO: 10499
  TaSBEIIa allele with mutations introduced by TALEN pair TaSBEIIa_T03

SEQ ID NO: 11074 - DNA, 458 bp, Artificial; identical to SEQ ID NO: 10338
  TaSBEIIa allele with mutations introduced by TALEN pair TaSBEIIa_T03

SEQ ID NO: 11075 - DNA, 416 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctggtgcctgacggtgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgcctggctcttgggccactgaa

SEQ ID NO: 11076 - DNA, 471 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggtcactgaa

SEQ ID NO: 11077 - DNA, 475 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagccttggccccgtgctggctcttgggccactgaa

SEQ ID NO: 11078 - DNA, 406 bp, Artificial
  TaSBEIIa allele with mutations introduced by TALEN pair TaSBEIIa_T03
  misc_feature (340): n is a or c or t or g
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgngcagtactgcactgccttgtgcattttgtagccgtggccccgtgctgggcctcttgggccactgaa

SEQ ID NO: 11079 - DNA, 487 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggtcctggtgcctgacggcgagagcgacgacttggcaagtccggcgcaacctgaagaattacaggtacacaccatcgtgccgggaaatcttcatacaatcgttattcacttaccaaatgccggatgaaaccaaccacggatgcgtcaggtttcgagcttcttctatcagcattgtgcagtactgcactgccttgttcattttgttagccttggccccgtgcctggctcttgggccactgaa

SEQ ID NO: 11080 - DNA, 455 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtccctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagtccttggccccgtgctggctcttgggccactgaa

SEQ ID NO: 11081 - DNA, 477 bp, Artificial
  TaSBEIIa allele with mutations introduced by TALEN pair TaSBEIIa_T03
gagagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagtccttggccccgtgcctggctcttgggccactgaa

SEQ ID NO: 11082 - DNA, 461 bp, Artificial
  TaSBEIIa allele with mutations introduced by TALEN pair TaSBEIIa_T03
  misc_feature (440): n is a or c or t or g
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgngctggctcttgggccactgaa

SEQ ID NO: 11083 - DNA, 415 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttgttagccgtggccccgtgctggctcttgggccactgaa

SEQ ID NO: 11084 - DNA, 407 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgttagccgtggccccgtgctggctcttgggccactgaa

SEQ ID NO: 11085 - DNA, 377 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 11086 - DNA, 334 bp, Artificial; identical to SEQ ID NO: 10407
  TaSBEIIa allele with mutations introduced by TALEN pair TaSBEIIa_T03

SEQ ID NO: 11087 - DNA, 472 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcgtcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggttcgagctcttctatcagcattgtgcagtactgcactgccttgttcattttgttagtccttggccccgtgctggctcttgggccactgaa

SEQ ID NO: 11088 - DNA, 467 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgggaagtcctggtgcctgacggcgagagcgacgacttggcaagtccggcgcaacctgaagaattacaggtacacacactcgtgccggtaaatcttcatacaatcgttattcacttaccaatgccggatgaaaccaaccacggatgcgtcaggtttcgagcttctctatcagcattgtgcagtactgcactgccttgttcatttgttagccttggccccgtgctggctcttgggccactgaa

SEQ ID NO: 11089 - DNA, 312 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatatttctcactctttcttctgttcttgctgtaactgcaagttgtagcattgtctcactattgtagtcatccttgcattacaatcgttattcacttaccaaatgccggatgaaaccaagccgcggaggcgtcaggtttgagcttcttctatcagcattgtgcagtactgcactgccttgtgcattttgtagccgtggccccgtgctggctcgttgggccactgaa

SEQ ID NO: 11090 - DNA, 433 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 11091 - DNA, 244 bp, Artificial
  TaSBEIIa allele with mutations introduced by TALEN pair TaSBEIIa_T03
gagagtagctggattaggcgatcgcctgcgtcagtgtcacccaggccctggtgttatcacggcttgatcatctcctcccattctgatattttctcactctttcttctgttcttgcttaccaatgccggatgaaaccaagccgcggaggcgtcaggtttgagcttcttctatcagcattgtgcagtactgcactgccttgtgcattttgttagccgtggcccgtgctggctcttgggccactgaa

SEQ ID NO: 11092 - DNA, 377 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgttggccccgtgctggctcttggggccactgaa

SEQ ID NO: 11093 - DNA, 394 bp, Artificial; identical to SEQ ID NO: 10559
  TaSBEIIa allele with mutations introduced by TALEN pair TaSBEIIa_T03

SEQ ID NO: 11094 - DNA, 472 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcgttgggccactgaa

SEQ ID NO: 11095 - DNA, 421 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcgttgggccactgaa

SEQ ID NO: 11096 - DNA, 467 bp, Artificial; identical to SEQ ID NO: 9077
  TaSBEIIa allele with mutations introduced by TALEN pair TaSBEIIa_T03

SEQ ID NO: 11097 - DNA, 377 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgttagccgtggccccgtgctggctcttggg

SEQ ID NO: 11098 - DNA, 388 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 11099 - DNA, 468 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcgtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 11100 - DNA, 473 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcgctggtgcctgacggcgagagcgacgacttggcaagtccggcgcaacctgaagaattacaggtacacacactcgtgccggtaaatcttcatacaatcgttattcacttaccaaatgccggatgaaaaccaaccacggatgcgtcaggtttcgagcttcttctatcagcattgtgcagtactgcactgccttgttcattttgttagccttggccccgtgctggctcttgggccactgaa

SEQ ID NO: 11101 - DNA, 442 bp, Artificial; identical to SEQ ID NO: 10017
  TaSBEIIa allele with mutations introduced by TALEN pair TaSBEIIa_T03

SEQ ID NO: 11102 - DNA, 460 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggccagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagtccttggccccgtgctggctcttgggccactgaa

SEQ ID NO: 11103 - DNA, 428 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcatttgtgcagtactgcactgccttgtgcattttgttagccgtggccccgtgctggctcttgggccactgaa

SEQ ID NO: 11104 - DNA, 416 bp, Artificial; identical to SEQ ID NO: 10470
  TaSBEIIa allele with mutations introduced by TALEN pair TaSBEIIa_T03

SEQ ID NO: 11105 - DNA, 426 bp, Artificial; identical to SEQ ID NO: 11051
  TaSBEIIa allele with mutations introduced by TALEN pair TaSBEIIa_T03

SEQ ID NO: 11106 - DNA, 420 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcatacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 11107 - DNA, 378 bp, Artificial; identical to SEQ ID NO: 10640
  TaSBEIIa allele with mutations introduced by TALEN pair TaSBEIIa_T03

SEQ ID NO: 11108 - DNA, 481 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcgttcgggccactgaa

SEQ ID NO: 11109 - DNA, 473 bp, Artificial; identical to SEQ ID NO: 10508
  TaSBEIIa allele with mutations introduced by TALEN pair TaSBEIIa_T03

SEQ ID NO: 11110 - DNA, 460 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagctttcttctatcagcattgtgcagtactgcactgccttgttcattttgttagccttggccccgtgctggctcttgggccactgaa

SEQ ID NO: 11111 - DNA, 471 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 11112 - DNA, 459 bp, Artificial; identical to SEQ ID NO: 10509
  TaSBEIIa allele with mutations introduced by TALEN pair TaSBEIIa_T03

SEQ ID NO: 11113 - DNA, 463 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctggtgcctgacggcgagagcgacgacttggcaagtccggcgcaacctgaagaattacaggtacacacactcgtgccggtaaatcttcatacaatcgttattcacttaccaaatgccggatgaaaaccaaccacggatgcgtcaggttttcgagcttcttctatcagcattgtgcagtactgcactgccttgttcattttgttagtccttggccccgtgctggctcttgggccactgaa

SEQ ID NO: 11114 - DNA, 442 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcgttgggccactgaa

SEQ ID NO: 11115 - DNA, 421 bp, Artificial
  TaSBEIIa allele with mutations introduced by TALEN pair TaSBEIIa_T03
gagagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 11116 - DNA, 416 bp, Artificial
  TaSBEIIa allele with mutations introduced by TALEN pair TaSBEIIa_T03
gagagatagctggattagggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 11117 - DNA, 453 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggcttttgggccactgaa

SEQ ID NO: 11118 - DNA, 458 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggccagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 11119 - DNA, 323 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgcatacaatcgttattcacttaccaatgccggatgaaaccaagccgcggaggcgtcaggttttgagcttcttctatcagcattgtgcagtactgcactgccttgtgcattttgtagccgtggccccgtgctggctcgttgggccactgaa

SEQ ID NO: 11120 - DNA, 404 bp, Artificial
  TaSBEIIa allele with mutations introduced by TALEN pair TaSBEIIa_T03
gagagatagctggattaggcgatcgcctcaggccctggtgttaccacggctttgatcatctcctcctttcatgctgatattttctcactctttttcttcctgttcttgctgtaactgcaagttgtggcgttttttcactattgtagtcatccttgcattttgcaggcgccgtcctgagccgcggagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 11121 - DNA, 387 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgacgacttggcaagtccggcgcaacctgaagaattacaggtacacaccatcgtgccgggaaatctcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 11122 - DNA, 398 bp, Artificial; identical to SEQ ID NO: 11018
  TaSBEIIa allele with mutations introduced by TALEN pair TaSBEIIa_T03

SEQ ID NO: 11123 - DNA, 330 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatcctccatcgtgccgggaaatcttcatacaatcgttattcacttaccaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 11124 - DNA, 429 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgatccggcgcaacctgaagaattacaggtacacacactcgtgccggtaaatcttcatacaatcgttattcacttaccaaatgccggatgaaaccaagccgcggaggcgtcaggttttgagcttctctatcagcattgtgcagtactgcactgccttgtgcattttgttagccgtggccccgtgctggctcttgggccactgaa

SEQ ID NO: 11125 - DNA, 467 bp, Artificial; identical to SEQ ID NO: 9077
  TaSBEIIa allele with mutations introduced by TALEN pair TaSBEIIa_T03

SEQ ID NO: 11126 - DNA, 461 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcagcttcttctatcagcattgtgcagtactgcactgccttgttcattttgttagccttggccccgtgctggctcttgggccactgaa

SEQ ID NO: 11127 - DNA, 488 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggtcctggtgcctgacggcgagagcgacgacttggcaagtccggcgcaaacctgaagaattacaggtacacacactcgtgccggtaaatcttcatacaatcgttattcacttaccaaatgccggatgaaaaccaaccacggatgcgtcaggtttcgagcttcttctatcagcattgtgcagtactgcactgccttgttcattttgttagccttggccccgtgctggctcttgggccactgaa

SEQ ID NO: 11128 - DNA, 388 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgacgacttggcaagtccggcgcaacctgaagaattacaggtacacaccatcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 11129 - DNA, 442 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagtccttggccccgtgctggctcttgggccactgaa

SEQ ID NO: 11130 - DNA, 451 bp, Artificial
  TaSBEIIa allele with mutations introduced by TALEN pair TaSBEIIa_T03
gagagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcattttgcaggcgccgtcctgagccgcgcggcctctccagggagcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 11131 - DNA, 305 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgcgctggctcttgggccactgaa

SEQ ID NO: 11132 - DNA, 458 bp, Artificial; identical to SEQ ID NO: 10297
  TaSBEIIa allele with mutations introduced by TALEN pair TaSBEIIa_T03

SEQ ID NO: 11133 - DNA, 417 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtccctggtgcctgacggtgagagcgacgacttggcaagtccggcgcaaccgtgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 11134 - DNA, 473 bp, Artificial; identical to SEQ ID NO: 10054
  TaSBEIIa allele with mutations introduced by TALEN pair TaSBEIIa_T03

SEQ ID NO: 11135 - DNA, 434 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcgttgggccactgaa

SEQ ID NO: 11136 - DNA, 384 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgtccattttgttagccttggccccgtgctggctcttgggccactgaa

SEQ ID NO: 11137 - DNA, 445 bp, Artificial; identical to SEQ ID NO: 10503
  TaSBEIIa allele with mutations introduced by TALEN pair TaSBEIIa_T03

SEQ ID NO: 11138 - DNA, 431 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagtcttcttctatcagcattgtgcagtactgcactgccttgtgcattttgttagccgtggccccgtgctggctcgttgggccactgaa

SEQ ID NO: 11139 - DNA, 397 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcaagtccggcgcaacctgaagaattacaggtacacgaccatcgtgccgggaaatcttcatacaatcgttattcacttaccaaatgccggatgaaaccagaccgcggaggcgtcaggttttgagcttctctatcagcattgtgcagtactgcactgccttgtgcattttgtagccgtggccccgtgctggctcttgggccactgaa

SEQ ID NO: 11140 - DNA, 430 bp, Artificial
  TaSBEIIa allele with mutations introduced by TALEN pair TaSBEIIa_T03
gagagatagctggattaggcgatcgcctcaggccctggtgttaccacggctttgatcatctcctcctttcatgctgatattttctcactctttcttctgttcttgctgtaactgcaagttgtagcattgtctcactattgtagtcatccttgcattgcaggcgccgtcctgagccgcgcggcctctccaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 11141 - DNA, 398 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtccagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttgttagccgtggccccgtgctggctcttgggccactgaa

SEQ ID NO: 11142 - DNA, 383 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccaagtccggcgcaacctgaagaattacaggtacacaccatcgtgcccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttggggccactgaa

SEQ ID NO: 11143 - DNA, 388 bp, Artificial; identical to SEQ ID NO: 9836
  TaSBEIIa allele with mutations introduced by TALEN pair TaSBEIIa_T03

SEQ ID NO: 11144 - DNA, 475 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggttcgagcttcttctatcagcattgtgcagtactgcactgccttgttcattttgttagccttggccccgtgctggctcttgggccactgaa

SEQ ID NO: 11145 - DNA, 463 bp, Artificial; identical to SEQ ID NO: 11010
  TaSBEIIa allele with mutations introduced by TALEN pair TaSBEIIa_T03

SEQ ID NO: 11146 - DNA, 457 bp, Artificial; identical to SEQ ID NO: 10620
  TaSBEIIa allele with mutations introduced by TALEN pair TaSBEIIa_T03

SEQ ID NO: 11147 - DNA, 405 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgttagccgtggccccgtgctggctcgttgggccactgaa

SEQ ID NO: 11148 - DNA, 470 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 11149 - DNA, 434 bp, Artificial; identical to SEQ ID NO: 10245
  TaSBEIIa allele with mutations introduced by TALEN pair TaSBEIIa_T03

SEQ ID NO: 11150 - DNA, 332 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattggtctcactattgtagtcatccttccatcgtgccgggaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 11151 - DNA, 456 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctgctcttgggccactgaa

SEQ ID NO: 11152 - DNA, 476 bp, Artificial
  TaSBEIIa allele with mutations introduced by TALEN pair TaSBEIIa_T03
gagagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcgggtgcctgacggcgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgttagccgtcggccccgtgctggctcgttcgggccactgaa

SEQ ID NO: 11153 - DNA, 429 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgcctggctcttgggccatgaa

SEQ ID NO: 11154 - DNA, 396 bp, Artificial; identical to SEQ ID NO: 10474
  TaSBEIIa allele with mutations introduced by TALEN pair TaSBEIIa_T03

SEQ ID NO: 11155 - DNA, 195 bp, Artificial
  TaSBEIIa allele with mutations introduced by TALEN pair TaSBEIIa_T03
gagagatagctggattaggcgatcgcctgcgtcagtgtcacccaggccctggtgttatcacggcttaccaaatgccggatgaaaccaagccgcggaggcgtcaggttttgagcttcttctatcagcattgtgcagtactgcactgccttgtgcattttgttagccgtggccccgtgctggctctgggccactgaa

SEQ ID NO: 11156 - DNA, 476 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcgggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 11157 - DNA, 422 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgtagccgtggccccgtgctggctcttgggccactgaa

SEQ ID NO: 11158 - DNA, 472 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctgtgcctgacggcgagagcgacgacttggcaagtccggcgcaacctgaagaattacaggtacacacactcgtgccggtaaatcttcatacaatcgttattcacttaccaaatgccggatgaaaccaacacggatgcgtcaggtttcgagcttcttctatcagcattgtgcagtactgcactgccttgttcattttgttagccttggccccgtgctggctcttgggccactgaa

SEQ ID NO: 11159 - DNA, 450 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcagggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 11160 - DNA, 401 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttggccactgaa

SEQ ID NO: 11161 - DNA, 300 bp, Artificial; identical to SEQ ID NO: 9996
  TaSBEIIa allele with mutations introduced by TALEN pair TaSBEIIa_T03

SEQ ID NO: 11162 - DNA, 452 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 11163 - DNA, 424 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgtggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggtttgagcttcttctatcagcattgtgcagtactgcactgccttgtgcattttgttagccgtggccccgtgctggctcttgggccactgaa

SEQ ID NO: 11164 - DNA, 407 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 11165 - DNA, 368 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttgttagccgtggccccgtgctggctcttgggccactgaa

SEQ ID NO: 11166 - DNA, 469 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 11167 - DNA, 297 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 11168 - DNA, 460 bp, Artificial; identical to SEQ ID NO: 10134
  TaSBEIIa allele with mutations introduced by TALEN pair TaSBEIIa_T03

SEQ ID NO: 11169 - DNA, 463 bp, Artificial; identical to SEQ ID NO: 10481
  TaSBEIIa allele with mutations introduced by TALEN pair TaSBEIIa_T03

SEQ ID NO: 11170 - DNA, 458 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctagctcttgggccactgaa

SEQ ID NO: 11171 - DNA, 421 bp, Artificial
  TaSBEIIa allele with mutations introduced by TALEN pair TaSBEIIa_T03
gagagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 11172 - DNA, 446 bp, Artificial
  TaSBEIIa allele with mutations introduced by TALEN pair TaSBEIIa_T03
gagagatagctagattaggcgatcgcctgcgtcagtgtcacccaggcccgtggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtggcattttgttagccgttggccccgttgctgggctcttgggccactgaa

SEQ ID NO: 11173 - DNA, 476 bp, Artificial
  TaSBEIIa allele with mutations introduced by TALEN pair TaSBEIIa_T03
gaggatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctcccggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 11174 - DNA, 421 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagctgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccggtggcccccgtgctggctcgttgggccactgaa

SEQ ID NO: 11175 - DNA, 430 bp, Artificial
  TaSBEIIa allele with mutations introduced by TALEN pair TaSBEIIa_T03
gagagatagctggattaggcgatcgcctcaggccctggtgttaccacggctttgatcatctcctcctttcatgctgatattttctcactctttcttctgttcttgctgtaactgcaagttgtagcattgtctcactattgtagtcatccttgcattgcaggcgccgtcctgagccgcgcggcctctccagggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 11176 - DNA, 430 bp, Artificial; identical to SEQ ID NO: 10283
  TaSBEIIa allele with mutations introduced by TALEN pair TaSBEIIa_T03

SEQ ID NO: 11177 - DNA, 435 bp, Artificial; identical to SEQ ID NO: 10444
  TaSBEIIa allele with mutations introduced by TALEN pair TaSBEIIa_T03

SEQ ID NO: 11178 - DNA, 435 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 11179 - DNA, 323 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcctgaagaattacaggtacacaccatcgtgccgggaaatcttcatacaatcgttattcacttaccaaatgccggatgaaaccaagccgcggaggcgtcaggtttgagcttctctatcagcattgtgcagtactgcactgccttgtgcattttgtagccgtggcccgtgctggctcttgggccactgaa

SEQ ID NO: 11180 - DNA, 474 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagccttggccccgtgctggctcttgggccactgaa

SEQ ID NO: 11181 - DNA, 470 bp, Artificial; identical to SEQ ID NO: 10913
  TaSBEIIa allele with mutations introduced by TALEN pair TaSBEIIa_T03

SEQ ID NO: 11182 - DNA, 477 bp, Artificial; identical to SEQ ID NO: 10171
  TaSBEIIa allele with mutations introduced by TALEN pair TaSBEIIa_T03

SEQ ID NO: 11183 - DNA, 430 bp, Artificial; identical to SEQ ID NO: 10182
  TaSBEIIa allele with mutations introduced by TALEN pair TaSBEIIa_T03

SEQ ID NO: 11184 - DNA, 471 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcaccccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagtccttggccccgtgctggctcttgggccactgaa

SEQ ID NO: 11185 - DNA, 374 bp, Artificial
  TaSBEIIa allele with mutations introduced by TALEN pair TaSBEIIa_T03
gagagatagctggattaggcgatcgcctcaggccctggtgttaccacggctttgatcattcctcgtttcattctgatatatattttctcactctttttcttcctgttcttgctgtaactgcaagttgtggcgttttttcactattgtagtcatccttgcattttgcaggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 11186 - DNA, 480 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggggaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 11187 - DNA, 472 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggtcctggtgcctgacggcgagagcgacgacttggcaagtccggcgcaacctgaagaattacaggtacacacactcgtgccggtaaatcttcatacaatcgttattcacttacaaatgccggatgaaaccaccacggatgcgtcaggtttcgagcttcttctatcagcattgtgcagtactgcactgccttgttcattttgtagccttggccccgtgctggctcttgggccactgaa

SEQ ID NO: 11188 - DNA, 472 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 11189 - DNA, 430 bp, Artificial
  TaSBEIIa allele with mutations introduced by TALEN pair TaSBEIIa_T03
  misc_feature (426): n is a or c or t or g
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggtcctggtgcctgacggtgagagcgacgacttggcaagtccggcgcaacctgaagaattacaggtacacaccatcgtgccggaaatcttcatacaatcgttattcacttaccaaatgccggatgaaaccaagccgcggaggcgtcaggttttgagcttcttctatcagcattgtgcagtactgcactgccttgtgctattttgttagccgtggccccgtgctggctcttgggccnctga

SEQ ID NO: 11190 - DNA, 459 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 11191 - DNA, 421 bp, Artificial
  TaSBEIIa allele with mutations introduced by TALEN pair TaSBEIIa_T03
gagagatagctggattaggcgatcgcgcttcctgaacctgttattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcatacttggcaagtccggcgcaacctgaagaattacaggtacacacactcgtgccggtaaatcttcatacaatcgttattcacttaccaaatgccggatgaaaaccaaccacggatgcgtcaggtttcgagcttcttctatcagcattgtgcagtactgcactgccttgtgcattttgtagccgtggccccgtgctggctcttgggccactgaa

SEQ ID NO: 11192 - DNA, 393 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcgacttggcaagtccggcgcaacctgaagaattacaggtacacaccatcgtgccgggaaatcttcatacaatcgttattcacttaccaaatgccggatgaaaccaagccgcggaggcgtacaggttttgagcttcttctatcagcattgtgcagtactgcactgccttgtgcattttgtagccgttggccccgtgctggctcttgggccactgaa

SEQ ID NO: 11193 - DNA, 414 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggtttgagcttcttctatcagcattgtgcagtactgcactgccttgtgcattttgttagccttggccccgtgctggctcttgggccactgaa

SEQ ID NO: 11194 - DNA, 461 bp, Artificial; identical to SEQ ID NO: 11009
  TaSBEIIa allele with mutations introduced by TALEN pair TaSBEIIa_T03

SEQ ID NO: 11195 - DNA, 454 bp, Artificial
  TaSBEIIa allele with mutations introduced by TALEN pair TaSBEIIa_T03
gagagatagctggattaggcgatcgcgcttcctgaacctgtattttttcccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 11196 - DNA, 472 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctccctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggcccccgtgctggctcttgggccactgaa

SEQ ID NO: 11197 - DNA, 401 bp, Artificial
  TaSBEIIa allele with mutations introduced by TALEN pair TaSBEIIa_T03
gagagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 11198 - DNA, 302 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctccattctgatattttctcactctttcttctgttcttgctgtaactgcaagttaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgttggccccgtgctggctcttgggccactgaa

SEQ ID NO: 11199 - DNA, 402 bp, Artificial; identical to SEQ ID NO: 10824
  TaSBEIIa allele with mutations introduced by TALEN pair TaSBEIIa_T03

SEQ ID NO: 11200 - DNA, 485 bp, Artificial
  TaSBEIIa allele with mutations introduced by TALEN pair TaSBEIIa_T03
gagagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggggaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagtccttcggccccgtgctggctcttgggccactgaa

SEQ ID NO: 11201 - DNA, 476 bp, Artificial; identical to SEQ ID NO: 11156
  TaSBEIIa allele with mutations introduced by TALEN pair TaSBEIIa_T03

SEQ ID NO: 11202 - DNA, 375 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgtagccgtggccccgtgctggctcttgggccactgaa

SEQ ID NO: 11203 - DNA, 480 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctacttttgttagtccttggccccgtgctggctcttgggccactga

SEQ ID NO: 11204 - DNA, 405 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtccggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 11205 - DNA, 390 bp, Artificial; identical to SEQ ID NO: 10914
  TaSBEIIa allele with mutations introduced by TALEN pair TaSBEIIa_T03

SEQ ID NO: 11206 - DNA, 471 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggtggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgtagccttggccccgtgctggctcttgggccactgaa

SEQ ID NO: 11207 - DNA, 275 bp, Artificial; identical to SEQ ID NO: 10907
  TaSBEIIa allele with mutations introduced by TALEN pair TaSBEIIa_T03

SEQ ID NO: 11208 - DNA, 368 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatatttctcactctttcttctgttcttgctgtaactgcaagttgtagcattgtctcactattgtagcgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgactggctcttgggccactgaa

SEQ ID NO: 11209 - DNA, 406 bp, Artificial; identical to SEQ ID NO: 9887
  TaSBEIIa allele with mutations introduced by TALEN pair TaSBEIIa_T03

SEQ ID NO: 11210 - DNA, 478 bp, Artificial
  TaSBEIIa allele with mutations introduced by TALEN pair TaSBEIIa_T03
gagagatagctggattaggcgatcgcgcttcctgaacctgtattttttcccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 11211 - DNA, 404 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcgtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttggggccactgaa

SEQ ID NO: 11212 - DNA, 477 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 11213 - DNA, 477 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcctggtgcctgacagcgagagcgacgacttggcaagtccggcgcaacctgaagaattacaggtacacacactcgtgccggtaaatcttcatacaatcgttatcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 11214 - DNA, 437 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggcccccgtgctggctcttgggccactgaa

SEQ ID NO: 11215 - DNA, 438 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagccttggccccgtgctggctcttgggccactgaa

SEQ ID NO: 11216 - DNA, 349 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgttagccgtggccccgtgctggctcttgggccactgaa

SEQ ID NO: 11217 - DNA, 435 bp, Artificial
  TaSBEIIa allele with mutations introduced by TALEN pair TaSBEIIa_T03
gagagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctggtgcctgacggtgagagcgacgacttggcggccactccagcgcaacccgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgttagccgtggccccgtgctggctcttgggccactgaa

SEQ ID NO: 11218 - DNA, 479 bp, Artificial; identical to SEQ ID NO: 9018
  TaSBEIIa allele with mutations introduced by TALEN pair TaSBEIIa_T03

SEQ ID NO: 11219 - DNA, 417 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagcctgcctgacggtgagagcgacgacttggcaagtccggcgcaacctgaagaattacaggtacacaccatcgtgccggaaatcttcatacaatcgttattcacttaccaaatgccggatgaaaccaagccgcggaggcgtcaggtttgagcttcttctatcagcattgtgcagtactgcactgccttgtgctatttgttagccgtggccccgtgctggctcttgggccactgaa

SEQ ID NO: 11220 - DNA, 356 bp, Artificial
  TaSBEIIa allele with mutations introduced by TALEN pair TaSBEIIa_T03
gagagatagctggattaggcgatcgcctgcgtcagtgtcacccaggccctggtgttaccacggctttgatcattcctcgtttcattctgatatatattttctcactcttttcttcctgttcttgctgtaactgcaagttgtggcgttttttcactattgtagtcatccttgcattttgcaggcgccgtcactcgtgccggtaaatcttcatacaatcgttattcacttaccaaatgccggatgaaaccaaccacggatgcgtcaggtttcgagcttcttctatcagcattgtgcagtactgcactgccttgttcattttgtagccttggccccgtgctggctcttgggccactgaa

SEQ ID NO: 11221 - DNA, 408 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcagggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggccactgaa

SEQ ID NO: 11222 - DNA, 418 bp, Artificial; identical to SEQ ID NO: 10061
  TaSBEIIa allele with mutations introduced by TALEN pair TaSBEIIa_T03

SEQ ID NO: 11223 - DNA, 396 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 11224 - DNA, 436 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 11225 - DNA, 442 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgaggcttcttctatcagcattgtgcagtactgcactgccttgtgcatttgttagccgtggccccgtgctggctcgttgggccactgaa

SEQ ID NO: 11226 - DNA, 486 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggtcctggtgcctgacggcgagagcgacgacttggcaagtccggcgcaacctgaagaattacaggtacacacactcgtgccggtaaatcttcatacaatcgttattcacttaccaaatgccggatgaaaccaacacggatgcgtcaggtttcgagcttcttctatcagcattgtgcagtactgcactgccttgttcattttgttagtccttggccccgtgctggctcttgggccactgaa

SEQ ID NO: 11227 - DNA, 405 bp, Artificial
  TaSBEIIa allele with mutations introduced by TALEN pair TaSBEIIa_T03
gagagagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgttagccgtggccccgtgctggctcttgggccactgaa

SEQ ID NO: 11228 - DNA, 429 bp, Artificial
  TaSBEIIa allele with mutations introduced by TALEN pair TaSBEIIa_T03
gagagatagctggattaggcgatcgcctcaggccctggtgttaccacggctttgatcatctcctcccattctgatattttctcactctttcttctgttcttgctgtaactgcaagttgtagcattgtctcactattgtagtcatccttgcattgcaggcgccgtcctgagccgcgcggcctctccagggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgttagccgtggccccgtgctggctcttgggccactgaa

SEQ ID NO: 11229 - DNA, 478 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 11230 - DNA, 422 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgttagccgtggccccgtgctggctcttgggccacgtgaa

SEQ ID NO: 11231 - DNA, 481 bp, Artificial; identical to SEQ ID NO: 10970
  TaSBEIIa allele with mutations introduced by TALEN pair TaSBEIIa_T03

SEQ ID NO: 11232 - DNA, 427 bp, Artificial
  TaSBEIIa allele with mutations introduced by TALEN pair TaSBEIIa_T03
  misc_feature (406): n is a or c or t or g
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcatttgcaggcgccgtcctgaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgngctggctcttgggccactgaa

SEQ ID NO: 11233 - DNA, 456 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagccttggcccccgtgctggctcttgggccactgaa

SEQ ID NO: 11234 - DNA, 479 bp, Artificial; identical to SEQ ID NO: 9018
  TaSBEIIa allele with mutations introduced by TALEN pair TaSBEIIa_T03

SEQ ID NO: 11235 - DNA, 452 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtgcctgacggcgagagcgacgacttggcaagtccggcgcaacctgaagaattacaggtacacacactcgtgccggtaaatcttcatacaatcgttattcacttaccaaatgccggatgaaaccaacacggatgcgtcaggtttcgagcttcttctatcagcattgtgcagtactgcactgccttgttcattttgtagccttggccccgtgctggctcttgggccactgaa

SEQ ID NO: 11236 - DNA, 472 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgtagccttggccccgtgctggctcttgggccactgaa

SEQ ID NO: 11237 - DNA, 336 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcaccatcgtgccgggaaatcttcatacaatcgttattcacttaccaaatgccggatgaaaccaagccgcggaggcgtcaggttttgagcttcttctatcagcattgtgcagtactgcactgccttgtgctattttgttagccgtggccccgtgctggctcttgggccactgaa

SEQ ID NO: 11238 - DNA, 382 bp, Artificial
  TaSBEIIa allele with mutations introduced by TALEN pair TaSBEIIa_T03
gagagatagctggattaggcgatcgcctcaggccctggtgttaccacggctttgatcatctcctcctttcatgctgatattttctcactctttttcttcctgttcttgctgtaactgcaagttgtggcgttttttcactattgtagtcatccttgcattttgcaggcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 11239 - DNA, 478 bp, Artificial; identical to SEQ ID NO: 10934
  TaSBEIIa allele with mutations introduced by TALEN pair TaSBEIIa_T03

SEQ ID NO: 11240 - DNA, 416 bp, Artificial; identical to SEQ ID NO: 10470
  TaSBEIIa allele with mutations introduced by TALEN pair TaSBEIIa_T03

SEQ ID NO: 11241 - DNA, 262 bp, Artificial; identical to SEQ ID NO: 9893
  TaSBEIIa allele with mutations introduced by TALEN pair TaSBEIIa_T03

SEQ ID NO: 11242 - DNA, 332 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgatcgtgccgggaaatcttcatacaatcgttattcacttaccaaatgccggatgaaaccaagccgcggaggcgtcaggttttgagcttcttctatcagcattgtgcagtactgcactgccttgtgctattttgttagccgtggccccgtgctggctcttgggccactgaa

SEQ ID NO: 11243 - DNA, 485 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactga

SEQ ID NO: 11244 - DNA, 313 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactggaa

SEQ ID NO: 11245 - DNA, 479 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctcgtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagctcttctatcagcattgtgcagtactgcactgccttgttcattttgttagccttggccccgtgctggctcttgggccactgaa

SEQ ID NO: 11246 - DNA, 425 bp, Artificial; identical to SEQ ID NO: 10571
  TaSBEIIa allele with mutations introduced by TALEN pair TaSBEIIa_T03

SEQ ID NO: 11247 - DNA, 435 bp, Artificial; identical to SEQ ID NO: 10554
  TaSBEIIa allele with mutations introduced by TALEN pair TaSBEIIa_T03

SEQ ID NO: 11248 - DNA, 424 bp, Artificial; identical to SEQ ID NO: 10200
  TaSBEIIa allele with mutations introduced by TALEN pair TaSBEIIa_T03

SEQ ID NO: 11249 - DNA, 251 bp, Artificial; identical to SEQ ID NO: 10029
  TaSBEIIa allele with mutations introduced by TALEN pair TaSBEIIa_T03

SEQ ID NO: 11250 - DNA, 430 bp, Artificial; identical to SEQ ID NO: 10318
  TaSBEIIa allele with mutations introduced by TALEN pair TaSBEIIa_T03

SEQ ID NO: 11251 - DNA, 443 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggccagtccggcgcaacctgaagaattacaggtacacacactcgtgccggtaaatcttcatacaatcgttattcacttaccaaatgccggatgaaaccaaccacggatgcgtcaggtttcgagcttcttctatccagcattgtgcagtactgcactgccttgttcattttgttagccttggccccgtgctggctcttgggccactgaa

SEQ ID NO: 11252 - DNA, 417 bp, Artificial
  TaSBEIIa allele with mutations introduced by TALEN pair TaSBEIIa_T03
gagagatagctggattaggcgatcgcctcaggccctggtgttaccacggctttgatcatctcctcctttcatgctgatattttctcactctttcttctgttcttgctgtaactgcaagttgtagcattgtctcactattgtagtcatccttgcattgcaggcgccgtcctgagccgcgcgctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 11253 - DNA, 404 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctgggctcttgggccactgaa

SEQ ID NO: 11254 - DNA, 414 bp, Artificial; identical to SEQ ID NO: 10682
  TaSBEIIa allele with mutations introduced by TALEN pair TaSBEIIa_T03

SEQ ID NO: 11255 - DNA, 433 bp, Artificial; identical to SEQ ID NO: 10361
  TaSBEIIa allele with mutations introduced by TALEN pair TaSBEIIa_T03

SEQ ID NO: 11256 - DNA, 473 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgtttttcactattgtagtcatccttgcattttgcaggcgccgtcctgagccgcgcggcctctccctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccacgtgaa

SEQ ID NO: 11257 - DNA, 262 bp, Artificial; identical to SEQ ID NO: 9893
  TaSBEIIa allele with mutations introduced by TALEN pair TaSBEIIa_T03

SEQ ID NO: 11258 - DNA, 465 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcagcttcttctatcagcattgtgcagtactgcactgccttgttcattttgttagccttggccccgtgctggctcttgggccactgaa

SEQ ID NO: 11259 - DNA, 278 bp, Artificial; identical to SEQ ID NO: 10209
  TaSBEIIa allele with mutations introduced by TALEN pair TaSBEIIa_T03

SEQ ID NO: 11260 - DNA, 246 bp, Artificial; identical to SEQ ID NO: 10117
  TaSBEIIa allele with mutations introduced by TALEN pair TaSBEIIa_T03

SEQ ID NO: 11261 - DNA, 437 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcgggaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgttagccgtggccccgtgctggctcttgggccactgaa

SEQ ID NO: 11262 - DNA, 243 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatatttctcactctttcttctgttcttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 11263 - DNA, 396 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 11264 - DNA, 480 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctctggtgcctgacggcgagagcgacgacttggcaagtccggcgcaacctgaagaattacaggtacacacactcgtgccggtaaatcttcatacaatcgttattcacttaccaaatgccggatgaaaccaagccgcggaggcgtcaggttttgagcttcttctatcagcattgtgcagtactgcactgccttgtgcattttgttagccgtggcccccgtgctggctcttgggccactgaa

SEQ ID NO: 11265 - DNA, 402 bp, Artificial; identical to SEQ ID NO: 10824
  TaSBEIIa allele with mutations introduced by TALEN pair TaSBEIIa_T03

SEQ ID NO: 11266 - DNA, 421 bp, Artificial
  TaSBEIIa allele with mutations introduced by TALEN pair TaSBEIIa_T03
  misc_feature (377): n is a or c or t or g
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggtttgagcttcttctatcagcattgtgcagtactgcactgccttgngcattttgtagccgtggccccgtgctggctcttgggccactgaa

SEQ ID NO: 11267 - DNA, 448 bp, Artificial
  TaSBEIIa allele with mutations introduced by TALEN pair TaSBEIIa_T03
gagagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcattttgcaggcgccgtcctgagccgcgcggcctcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 11268 - DNA, 431 bp, Artificial; identical to SEQ ID NO: 10179
  TaSBEIIa allele with mutations introduced by TALEN pair TaSBEIIa_T03

SEQ ID NO: 11269 - DNA, 464 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 11270 - DNA, 478 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggggcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttctctatcagcattgtgcagtactgcactgccttgttcattttgttagccttggccccgtgcctggctcttgggccactgaa

SEQ ID NO: 11271 - DNA, 265 bp, Artificial; identical to SEQ ID NO: 9938
  TaSBEIIa allele with mutations introduced by TALEN pair TaSBEIIa_T03

SEQ ID NO: 11272 - DNA, 422 bp, Artificial; identical to SEQ ID NO: 10226
  TaSBEIIa allele with mutations introduced by TALEN pair TaSBEIIa_T03

SEQ ID NO: 11273 - DNA, 449 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagcagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagtccttggccccgtgctggctcttgggccactgaa

SEQ ID NO: 11274 - DNA, 486 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcatgtgcagtactgcactgccttgttcattttgttagccttggccccgtgctggctcttgggccactcgaa

SEQ ID NO: 11275 - DNA, 487 bp, Artificial
  TaSBEIIa allele with mutations introduced by TALEN pair TaSBEIIa_T03
gagagatagctggattaggcgatcgcgcttcctgaacctgtattttttcccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggtcctgggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagccttggccccgtgctggctcttgggccactgaa

SEQ ID NO: 11276 - DNA, 443 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctactccagggtcctggtgcctgacggtgagagcgacgacttggcaagtccggcgcaacctgaagaattacaggtacacaccatcgtgccgggaaatcttcatacaatcgttattcacttaccaaatgccggatgaaaccaaagccgcggaggcgtcaggttttgagcttcttctatcagcattgtgcagtactgcactgccttgtgcattttgtagccgtggccccgtgctggctcttgggccactgaa

SEQ ID NO: 11277 - DNA, 460 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttgtccccgtgctggctcttgggccactgaa

SEQ ID NO: 11278 - DNA, 477 bp, Artificial; identical to SEQ ID NO: 10171
  TaSBEIIa allele with mutations introduced by TALEN pair TaSBEIIa_T03

SEQ ID NO: 11279 - DNA, 376 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgttggccccgtgctggctcttggggccactgaa

SEQ ID NO: 11280 - DNA, 302 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatatttctcactctttcttctgttcttgctgtaattacaggtacacaccatcgtgccggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 11281 - DNA, 377 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgttagccgtggccccgtgctggctcttgggccactgaa

SEQ ID NO: 11282 - DNA, 467 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcgtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagtccttggccccgtgctggctcttggccactgaa

SEQ ID NO: 11283 - DNA, 444 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccagggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgacggaggcgtcaggttttgagtcttcttctatcagcattgtgcagtactgcactgccttgtgctattttgttagccgtggccccgtgctggctcttgggccactga

SEQ ID NO: 11284 - DNA, 409 bp, Artificial; identical to SEQ ID NO: 10228
  TaSBEIIa allele with mutations introduced by TALEN pair TaSBEIIa_T03

SEQ ID NO: 11285 - DNA, 472 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcgcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgtagccttggccccgtgctggctcttgggccactgaa

SEQ ID NO: 11286 - DNA, 443 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccagggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgttagccgtggccccgtgctggctcttgggccactgaa

SEQ ID NO: 11287 - DNA, 195 bp, Artificial; identical to SEQ ID NO: 9876
  TaSBEIIa allele with mutations introduced by TALEN pair TaSBEIIa_T03

SEQ ID NO: 11288 - DNA, 423 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgtagccgtggccccgtgctggctcttgggccactgaa

SEQ ID NO: 11289 - DNA, 434 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcttggcaagtccggcgcaacctgaagaattacaggtacacacactcgtgccggtaaatcttcatacaatcgttattcacttaccaaatgccggatgaaaccaaccacggatgcgtcaggttttcgagcttcttctatcagcattgtgcagtactgcactgccttgttcattttgttagccttggccccgtgctggctcttgggccactgaa

SEQ ID NO: 11290 - DNA, 402 bp, Artificial; identical to SEQ ID NO: 10824
  TaSBEIIa allele with mutations introduced by TALEN pair TaSBEIIa_T03

SEQ ID NO: 11291 - DNA, 435 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggtttcgagcttcttctatcagcattgtgcagtactgcactgccttgttcattttgttagccttggccccgtgctggctcttgggccactgaa

SEQ ID NO: 11292 - DNA, 335 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcaccatcgtgccgggaaatcttcatacaatcgttattcacttaccaaatgccggatgaaaccaagccgcggaggcgtcgaggttttgagcttcttctatcagcattgtgcagtactgcactgccttgtgcattttgttagccgtggcccgtgctggctcttgggccactgaa

SEQ ID NO: 11293 - DNA, 406 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcgacttggcaagtccggcgcaacctgaagaattacaggtacacaccatcgtgccgggaaatcttcatacaatcgttattcacttaccaaatgccggatgaaaccaagccgcggaggcatcaggtttcaagcttcttctatcagcattgtgcactacttcactgccttgtgcagtttgttagctgtggccccgcgctggctcttgggccactgaa

SEQ ID NO: 11294 - DNA, 388 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcagacgacttggcaagtccggcgcaacctgaagaattacaggtacacaccatcgtgccgggaaatcttcatacaatcgttattcacttaccaaatgaccggatgaaaccaagccgcggaggcgtcaggttttgagcttcttctatcagcattgtgcagtactgcactgccttgtgctattttgttagccgtggccccgtgctggctcttgggccactgaa

SEQ ID NO: 11295 - DNA, 481 bp, Artificial; identical to SEQ ID NO: 10970
  TaSBEIIa allele with mutations introduced by TALEN pair TaSBEIIa_T03

SEQ ID NO: 11296 - DNA, 415 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggtgccgtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 11297 - DNA, 437 bp, Artificial; identical to SEQ ID NO: 10979
  TaSBEIIa allele with mutations introduced by TALEN pair TaSBEIIa_T03

SEQ ID NO: 11298 - DNA, 464 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcgcctgacggcgagagcgacgacttggcaagtccggcgcaacctgaagaattacaggtacacacactcgtgccggtaaatcttcatacaatcgttattcacttaccaatgccggatgaaaccaccacggatgcgtcaggtttcgagcttcttctatcagcattgtgcagtactgcactgccttgttcattttgttagccttggtcccgtgctggctcttgggccactgaa

SEQ ID NO: 11299 - DNA, 466 bp, Artificial; identical to SEQ ID NO: 10479
  TaSBEIIa allele with mutations introduced by TALEN pair TaSBEIIa_T03

SEQ ID NO: 11300 - DNA, 369 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagcgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgtagccgtggccccgtgctggctcgttgggccactgaa

SEQ ID NO: 11301 - DNA, 435 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcgggtcctggtgcctgacggtgagagcgacgacttggcaagtccggcgcaacctgaagaattacaggtacacaccatcgtgccgggaaatcttcatacaatcgttaattcacttaccaaatgccggatgaaaccaagccgcggaggcgtcaggttttgagcttcttctatcagcattgtgcagtactgcactgccttgtgctattttgttagccgtggccccgtgctggctcttgggccactggaa

SEQ ID NO: 11302 - DNA, 460 bp, Artificial
  TaSBEIIa allele with mutations introduced by TALEN pair TaSBEIIa_T03
  misc_feature (395): n is a or c or t or g
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgngcagtactgcactgccttgttcattttgtagtccttggccccgtgctggctcttgggccactgaa

SEQ ID NO: 11303 - DNA, 465 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcagcttcttctatcagcattgtgcagtactgcactgccttgttctattttgttagccttggccccgtgctggctcttgggccactgaa

SEQ ID NO: 11304 - DNA, 451 bp, Artificial; identical to SEQ ID NO: 10282
  TaSBEIIa allele with mutations introduced by TALEN pair TaSBEIIa_T03

SEQ ID NO: 11305 - DNA, 453 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgcctgacggcgagagcgacgacttggcaagtccggcgcaacctgaagaattacaggtacacaccatcgtgccgggaatcttcatacaatcgttaattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 11306 - DNA, 420 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 11307 - DNA, 486 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgtaggcgccgtcctgagccgcgcggcctctccagggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 11308 - DNA, 476 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcgggtcctggtgcctgacggcgagagcgacgacttggcaagtccggcgcaacctgaagaattacaggtacacacactcgtgccggtaaatcttcatacaatcgttattcacttaccaaatgccggatgaaaaccaaccacggatgcgtcaggtttcgagcttcttctatcagcattgtgcagtactgcactgccttgttcattttgtagccttggccccgtgctggctcttgggccactgaa

SEQ ID NO: 11309 - DNA, 381 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgtcattttgtagccttggccccgtgctggctcttgggccactgaa

SEQ ID NO: 11310 - DNA, 442 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttctattttgttagccttggccccgtgctggctcttgggccactgaa

SEQ ID NO: 11311 - DNA, 471 bp, Artificial; identical to SEQ ID NO: 9391
  TaSBEIIa allele with mutations introduced by TALEN pair TaSBEIIa_T03

SEQ ID NO: 11312 - DNA, 407 bp, Artificial; identical to SEQ ID NO: 10263
  TaSBEIIa allele with mutations introduced by TALEN pair TaSBEIIa_T03

SEQ ID NO: 11313 - DNA, 354 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactatggcaagtccggcgcaacctgaagaattacaggtacacacactcgtgccggtaaatcttcatacaatcgttattcacttaccaaatgccgatgaaaccaaccacggatgcgtcaggttcgagcttcttctatcagcattgtgcagtactgcactgccttgttcattttgttagccttggccccgtgctggctcttgggccactgaa

SEQ ID NO: 11314 - DNA, 468 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcagcttcttctatcagcattgtgcagtactgcactgccttgttcattttgttagccttggccccgtgctggctcttgggccactgaa

SEQ ID NO: 11315 - DNA, 291 bp, Artificial
  TaSBEIIa allele with mutations introduced by TALEN pair TaSBEIIa_T03
gagagatagctggattaggcgatcgcctcaggccctggtgttaccacggctttgatcatctcctcccattctgatattttctcactctttcttctgttcttgctgtaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 11316 - DNA, 462 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctgggctcgttgggccactgaa

SEQ ID NO: 11317 - DNA, 473 bp, Artificial; identical to SEQ ID NO: 10036
  TaSBEIIa allele with mutations introduced by TALEN pair TaSBEIIa_T03

SEQ ID NO: 11318 - DNA, 327 bp, Artificial; identical to SEQ ID NO: 10113
  TaSBEIIa allele with mutations introduced by TALEN pair TaSBEIIa_T03

SEQ ID NO: 11319 - DNA, 384 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcaactgccttgtgcattttgttagccgtggccccgtgcctggctcttggggccactgaa

SEQ ID NO: 11320 - DNA, 440 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccagggtcctggtgcctgacggtgagagcgacgacttggcaagtccggcgcaacctgagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 11321 - DNA, 426 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcgaggttttgagcttcttctatcagcattgtgcagtactgcactgccttgtgctattttgttagccgttggccccgtgctggctcttgggccactgaa

SEQ ID NO: 11322 - DNA, 478 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagtccttggccccgtgctggctcttgggccactgaa

SEQ ID NO: 11323 - DNA, 467 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcgtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgtagccttggccccgtgctggctcttgggccactgaa

SEQ ID NO: 11324 - DNA, 475 bp, Artificial; identical to SEQ ID NO: 10305
  TaSBEIIa allele with mutations introduced by TALEN pair TaSBEIIa_T03

SEQ ID NO: 11325 - DNA, 310 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattacaatcgttattcacttaccaaatgccggatgaaaccaagccgcggaggcgtcaggtttgagcttcttctatcagcattgtgcagtactgcactgccttgtgcattttgtagccgtggcccgtgctggctctgggccactgaa

SEQ ID NO: 11326 - DNA, 461 bp, Artificial
  TaSBEIIa allele with mutations introduced by TALEN pair TaSBEIIa_T03
gagagatagctggattaggcgatcgcgcttcctgaacctgtattttttcccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggttttcgagcttcttctatcagcattgtgcagtactgcactgccttgttctattttgttagccttggccccgtgctggctcttgggccactgaa

SEQ ID NO: 11327 - DNA, 416 bp, Artificial; identical to SEQ ID NO: 10470
  TaSBEIIa allele with mutations introduced by TALEN pair TaSBEIIa_T03

SEQ ID NO: 11328 - DNA, 469 bp, Artificial; identical to SEQ ID NO: 11166
  TaSBEIIa allele with mutations introduced by TALEN pair TaSBEIIa_T03

SEQ ID NO: 11329 - DNA, 435 bp, Artificial; identical to SEQ ID NO: 10554
  TaSBEIIa allele with mutations introduced by TALEN pair TaSBEIIa_T03

SEQ ID NO: 11330 - DNA, 455 bp, Artificial; identical to SEQ ID NO: 10157
  TaSBEIIa allele with mutations introduced by TALEN pair TaSBEIIa_T03

SEQ ID NO: 11331 - DNA, 469 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcgggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttctctatcagcattgtgcagtactgcactgccttgttcattttgttagccttggccccgtgctggctcttgggccactgaa

SEQ ID NO: 11332 - DNA, 429 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctggtgcctgacggtgagagcgacgacttggcaagtccggcgcaacctgaagaattacaggtacacaccatcgtgccgggaaatcttcatacaatcgttattcacttaccaaatgccggatgaaaccagccgcggaggcgtcaggttttgagcttcttctatcagcattgtgcagtactgcactgccttgtgcattttgttagccgtggccccgtgctggctcttgggccactgaa

SEQ ID NO: 11333 - DNA, 471 bp, Artificial; identical to SEQ ID NO: 9391
  TaSBEIIa allele with mutations introduced by TALEN pair TaSBEIIa_T03

SEQ ID NO: 11334 - DNA, 476 bp, Artificial
  TaSBEIIa allele with mutations introduced by TALEN pair TaSBEIIa_T03
gagagatagctggattaggcgatcgcgcttcctgaacctgtattttttcccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 11335 - DNA, 439 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctgggaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctctgggccactgaa

SEQ ID NO: 11336 - DNA, 436 bp, Artificial; identical to SEQ ID NO: 9954
  TaSBEIIa allele with mutations introduced by TALEN pair TaSBEIIa_T03

SEQ ID NO: 11337 - DNA, 365 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcatctcctcccattctgatattttctcactctttcttctgttcttgctgtaactgcaagttgtagcattgtctcactattgtagtcatcctccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 11338 - DNA, 452 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 11339 - DNA, 473 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggtggtgcctgacggcgagagcgacgacttggcaagtccggcgcaacctgaagaattacaggtacacacactcgtgccggtaaatcttcatacaatcgttattcacttaccaaatgccggatgaaaccaacacggatgcgtcaggtttcgagcttcttctatcagcattgtgcagtactgcactgccttgttctattttgttagtccttggccccgtgctggctcttgggccactgaa

SEQ ID NO: 11340 - DNA, 474 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagtccttggccccgtgctggctcttgggccactgaa

SEQ ID NO: 11341 - DNA, 385 bp, Artificial; identical to SEQ ID NO: 10543
  TaSBEIIa allele with mutations introduced by TALEN pair TaSBEIIa_T03

SEQ ID NO: 11342 - DNA, 446 bp, Artificial
  TaSBEIIa allele with mutations introduced by TALEN pair TaSBEIIa_T03
gagagatagctggattaggcgatcgcgcttcctgaacctgtattttttcccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 11343 - DNA, 452 bp, Artificial; identical to SEQ ID NO: 11162
  TaSBEIIa allele with mutations introduced by TALEN pair TaSBEIIa_T03

SEQ ID NO: 11344 - DNA, 426 bp, Artificial; identical to SEQ ID NO: 11051
  TaSBEIIa allele with mutations introduced by TALEN pair TaSBEIIa_T03

SEQ ID NO: 11345 - DNA, 475 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccggaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 11346 - DNA, 384 bp, Artificial; identical to SEQ ID NO: 9842
  TaSBEIIa allele with mutations introduced by TALEN pair TaSBEIIa_T03

SEQ ID NO: 11347 - DNA, 330 bp, Artificial; identical to SEQ ID NO: 10235
  TaSBEIIa allele with mutations introduced by TALEN pair TaSBEIIa_T03

SEQ ID NO: 11348 - DNA, 466 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggcactgaa

SEQ ID NO: 11349 - DNA, 470 bp, Artificial; identical to SEQ ID NO: 10262
  TaSBEIIa allele with mutations introduced by TALEN pair TaSBEIIa_T03

SEQ ID NO: 11350 - DNA, 429 bp, Artificial
  TaSBEIIa allele with mutations introduced by TALEN pair TaSBEIIa_T03
gagagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcgggaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtacttcactgccttgtgcagtttgttagctgtggccccgcgctggctcttgggccactgaa

SEQ ID NO: 11351 - DNA, 318 bp, Artificial
  TaSBEIIa allele with mutations introduced by TALEN pair TaSBEIIa_T03
gagagatagctggattaggcgatcgcctgcgtcagtgtcacccaggccctggtgttaccacggctttgatcattcctcgtttcattctgatatatattttctcactcttttcttcctgttcttgctgtaactgcagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgtagccttggcccgtgctggctcttgggccactgaa

SEQ ID NO: 11352 - DNA, 432 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccggaaggtcctggtgcctgacggtgagagcgacgacttggcaagtccggcgcaacctgaacgaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagtccgtggccccgtgctggctcttgggccactgaa

SEQ ID NO: 11353 - DNA, 475 bp, Artificial
  TaSBEIIa allele with mutations introduced by TALEN pair TaSBEIIa_T03
gagagatgctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttctattttgttagccttcggccccgtgcgtggctcgttgggccactgaa

SEQ ID NO: 11354 - DNA, 409 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccggtggccccgtgctgggctcgttgggccactgaa

SEQ ID NO: 11355 - DNA, 460 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggggaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcagcttcttctatcagcattgtgcagtactgcactgccttgttcattttgttagccttggccccgtgctggctcttgggccactgaa

SEQ ID NO: 11356 - DNA, 372 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgctggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 11357 - DNA, 474 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctggtgcctgacggcgagagcgacgacttggcaagtccggcgcaacctgaagaattacaggtacacacactcgtgccggtaaatcttcatacaatcgttattcacttaccaaatgccggatgaaaaccaccacggatgcgtcaggtttcgagcttcttctatcagcattgtgcagtactgcactgccttgttcattttgttagccttggccccgtgctggctcttgggccactgaa

SEQ ID NO: 11358 - DNA, 482 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggggaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagccttggccccgtgcctggctcttgggccactgaa

SEQ ID NO: 11359 - DNA, 391 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagtcttcttctatcagcattgtgcagtactgcactgccttgtgctattttgttagccgtggccccgtgctggctcttgggccactgaa

SEQ ID NO: 11360 - DNA, 441 bp, Artificial
  TaSBEIIa allele with mutations introduced by TALEN pair TaSBEIIa_T03
gagagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 11361 - DNA, 326 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttcgtgccgggaaatcttcatacaatcgttattcacttaccaaatgccggatgaaaccaagccgcggaggcgtcaggtttgagcttcttctatcagcattgtgcagtactgcactgccttgtgcattttgtagccgtggccccgtgctggctcttgggccactgaa

SEQ ID NO: 11362 - DNA, 480 bp, Artificial; identical to SEQ ID NO: 10186
  TaSBEIIa allele with mutations introduced by TALEN pair TaSBEIIa_T03

SEQ ID NO: 11363 - DNA, 366 bp, Artificial
  TaSBEIIa allele with mutations introduced by TALEN pair TaSBEIIa_T03
gaggatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagcgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 11364 - DNA, 398 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcacttctttcttctgttcttgctgtaactgcaagttgtagcattgtctcactattgtagtcatccttgcattgcaggcgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgttagccgtggccccgtgctggctcttgggccacgtgaa

SEQ ID NO: 11365 - DNA, 336 bp, Artificial; identical to SEQ ID NO: 11237
  TaSBEIIa allele with mutations introduced by TALEN pair TaSBEIIa_T03

SEQ ID NO: 11366 - DNA, 477 bp, Artificial; identical to SEQ ID NO: 10171
  TaSBEIIa allele with mutations introduced by TALEN pair TaSBEIIa_T03

SEQ ID NO: 11367 - DNA, 453 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgttgctggctcttgggccactgaa

SEQ ID NO: 11368 - DNA, 480 bp, Artificial; identical to SEQ ID NO: 10186
  TaSBEIIa allele with mutations introduced by TALEN pair TaSBEIIa_T03

SEQ ID NO: 11369 - DNA, 484 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcgttgggccactgaa

SEQ ID NO: 11370 - DNA, 461 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttctctatcagcattgtgcagtactgcactgccttgttcattttgttagccttggccccgtgctggctcttgggccactgaa

SEQ ID NO: 11371 - DNA, 464 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggttttcgagcttcttctatcagcattgtgcagtactgcactgccttgttctattttgttagtccttggccccgtgctggctcttgggccactgaa

SEQ ID NO: 11372 - DNA, 441 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccagggcctggtgcctgacggtgagagcgacgacttggcaagtccggcgcaacctgaagattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgttagccgtggccccgtgctggctcttgggccactgaa

SEQ ID NO: 11373 - DNA, 367 bp, Artificial; identical to SEQ ID NO: 10395
  TaSBEIIa allele with mutations introduced by TALEN pair TaSBEIIa_T03

SEQ ID NO: 11374 - DNA, 416 bp, Artificial; identical to SEQ ID NO: 10470
  TaSBEIIa allele with mutations introduced by TALEN pair TaSBEIIa_T03

SEQ ID NO: 11375 - DNA, 487 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagtccttggccccgtgcctggctcttgggccactgaa

SEQ ID NO: 11376 - DNA, 435 bp, Artificial; identical to SEQ ID NO: 10845
  TaSBEIIa allele with mutations introduced by TALEN pair TaSBEIIa_T03

SEQ ID NO: 11377 - DNA, 464 bp, Artificial; identical to SEQ ID NO: 11269
  TaSBEIIa allele with mutations introduced by TALEN pair TaSBEIIa_T03

SEQ ID NO: 11378 - DNA, 409 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtggtgagagcgacgacttggcaaggtccggcgcaacctgaacgaattacaggtacacaccatcgtgccgggaaatcttcatacaatcgttaattcacttaccaaatgccggatgaaaccaagccgcggaggcgtcaggttttgagcttcttctatcagcattgtgcagttactgcactgccttgtgctatttgttagccgtggccccgtgctgggctcttgggccacttgaa

SEQ ID NO: 11379 - DNA, 475 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctggtgcctgacggcgagagcgacgacttggcaagtccggcgcaacctgaagaattacaggtacacacactcgtgccggtaaatcttcatacaatcgttatcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 11380 - DNA, 420 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaaagtccggcgcaacctgaagaattacaggtacacacactcgtgccggtaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 11381 - DNA, 415 bp, Artificial
  TaSBEIIa allele with mutations introduced by TALEN pair TaSBEIIa_T03
gagagatagctggattaggcgatcgcctgcgtcagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 11382 - DNA, 482 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagtcgtggcgttttttcactattgtagtcatccttgcattttgcaggcgccgtcctgagccgcgcgggaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagtccttggccccgtgctggctcttgggccactgaa

SEQ ID NO: 11383 - DNA, 448 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttggccactgaa

SEQ ID NO: 11384 - DNA, 425 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgttagccgtggccccgtgctggctcgttgggccactgaa

SEQ ID NO: 11385 - DNA, 421 bp, Artificial
  TaSBEIIa allele with mutations introduced by TALEN pair TaSBEIIa_T03
gagagatagctggattaggcgatcgcctcaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcgggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 11386 - DNA, 472 bp, Artificial; identical to SEQ ID NO: 10900
  TaSBEIIa allele with mutations introduced by TALEN pair TaSBEIIa_T03

SEQ ID NO: 11387 - DNA, 455 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttgccccgtgctggctcttgggccactgaa

SEQ ID NO: 11388 - DNA, 463 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgcctggctcttgggccactgaa

SEQ ID NO: 11389 - DNA, 199 bp, Artificial
  TaSBEIIa allele with mutations introduced by TALEN pair TaSBEIIa_T03
gagagatagctggattaggcgatcgcctcaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgtgctggctcttgggccactgaa

SEQ ID NO: 11390 - DNA, 462 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggacggcgagagcgacgacttggcaagtccggcgcaaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccatgaa

SEQ ID NO: 11391 - DNA, 418 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattttgcaggcgccgtcctgtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttctctatcagcattgtgcagtactgcactgccttgttctattttgttagtccttggccccgtgcctggctcttgggccactgaa

SEQ ID NO: 11392 - DNA, 423 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgtgcctgacggtgagagcgacgacttggcaagtccggcgcaacctgaagaattacaggtacacaccatcgtgccggtaaatcttcatacaatcgttattcacttaccaaatgccggatgaaaccaagccgcggaggcgtcaggttttgagcttcttctatcagcattgtgcagtactgcactgccttgtgctattttgttagccgttggccccgtgctggctcgttgggccactgaa

SEQ ID NO: 11393 - DNA, 447 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagcagcgacgacttggcaagtccggcgcaacctgaagaattacaggtacacacactcgtgccggtaaatcttcatacaatcgttattcacttaccaaatgccggatgaaaccaaccacggatgcgtcaggtttcagcttcttctatcagcattgtgcagtactgcactgccttgttcattttgttagccttggccccgtgctggctcttgggccactgaa

SEQ ID NO: 11394 - DNA, 467 bp, Artificial
  TaSBEIIa allele with mutations introduced by TALEN pair TaSBEIIa_T03
gagagatagctggattaggcgatcgcgcttcctgaacctgttattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 11395 - DNA, 195 bp, Artificial; identical to SEQ ID NO: 9805
  TaSBEIIa allele with mutations introduced by TALEN pair TaSBEIIa_T03

SEQ ID NO: 11396 - DNA, 454 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggccctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 11397 - DNA, 449 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcatgtgcagtactgcactgccttgttcattttgttagccttggccccgtgctggctcttgggccactgaa

SEQ ID NO: 11398 - DNA, 484 bp, Artificial; identical to SEQ ID NO: 8973
  TaSBEIIa allele with mutations introduced by TALEN pair TaSBEIIa_T03

SEQ ID NO: 11399 - DNA, 457 bp, Artificial; identical to SEQ ID NO: 10259
  TaSBEIIa allele with mutations introduced by TALEN pair TaSBEIIa_T03

SEQ ID NO: 11400 - DNA, 481 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcctggtgcctgacagcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagtccttggccccgtgctggctcttgggccactgaa

SEQ ID NO: 11401 - DNA, 466 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcgcctgacggcgagagcgacgacttggcaagtccggcgcaacctgaagaattacaggtacacacactcgtgccggtaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 11402 - DNA, 430 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcgtcctggtgcctgacggtgagagcgacgacttggcaagtccggcgcaacctgaagaattacaggtacacaccgtcgtgccggaaaatcttcatgcacccgttatcacttaccaaatatcggatgaaccaagccgcggaggcatcaggtttcaaggcttcttctatcagcattgtgcactacttcactgccttgtgcagtttgttagcttgtggccccgcgctggctcttgggccactgaa

SEQ ID NO: 11403 - DNA, 414 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtccggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctctgggccactgaa

SEQ ID NO: 11404 - DNA, 199 bp, Artificial; identical to SEQ ID NO: 9811
  TaSBEIIa allele with mutations introduced by TALEN pair TaSBEIIa_T03

SEQ ID NO: 11405 - DNA, 426 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgtgcattttgtagccgtggccccgtgctggctcttgggccactgaa

SEQ ID NO: 11406 - DNA, 401 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 11407 - DNA, 437 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgttagccgtggccccgtgctggctcgttgggccactgaa

SEQ ID NO: 11408 - DNA, 202 bp, Artificial; identical to SEQ ID NO: 9791
  TaSBEIIa allele with mutations introduced by TALEN pair TaSBEIIa_T03

SEQ ID NO: 11409 - DNA, 401 bp, Artificial; identical to SEQ ID NO: 11406
  TaSBEIIa allele with mutations introduced by TALEN pair TaSBEIIa_T03

SEQ ID NO: 11410 - DNA, 475 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgggaaggtcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 11411 - DNA, 474 bp, Artificial; identical to SEQ ID NO: 9013
  TaSBEIIa allele with mutations introduced by TALEN pair TaSBEIIa_T03

SEQ ID NO: 11412 - DNA, 479 bp, Artificial; identical to SEQ ID NO: 9018
  TaSBEIIa allele with mutations introduced by TALEN pair TaSBEIIa_T03

SEQ ID NO: 11413 - DNA, 285 bp, Artificial; identical to SEQ ID NO: 10266
  TaSBEIIa allele with mutations introduced by TALEN pair TaSBEIIa_T03

SEQ ID NO: 11414 - DNA, 333 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttccatcgtgccgggaaatcttcatacaatcgttattcacttaccaaatgccggatgaaaccaagccgcggaggcgtcaggttttgagcttcttctatcagcattgtgcagtactgcactgccttgtgctattttgttagccgtggccccgtgctggctcttgggccactgaa

SEQ ID NO: 11415 - DNA, 470 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcgtgggccactgaa

SEQ ID NO: 11416 - DNA, 476 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctggtgcctaacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcgttcgggccactgaa

SEQ ID NO: 11417 - DNA, 455 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgtcctggtgcctgacggcgagagcgacgacttggcaagtccggcgcaacctgaagaattacaggtacacacactcgtgccggtaaatcttcatacaatcgttatcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 11418 - DNA, 488 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagtccttggccccgtgctggctcttgggccactgaa

SEQ ID NO: 11419 - DNA, 471 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcgggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagtccttggccccgtgctggctcttgggccactgaa

SEQ ID NO: 11420 - DNA, 450 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagcctttggccccgtgctggctcttgggccactgaa

SEQ ID NO: 11421 - DNA, 442 bp, Artificial; identical to SEQ ID NO: 10017
  TaSBEIIa allele with mutations introduced by TALEN pair TaSBEIIa_T03

SEQ ID NO: 11422 - DNA, 461 bp, Artificial
  TaSBEIIa allele with mutations introduced by TALEN pair TaSBEIIa_T03
gagagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 11423 - DNA, 412 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggccgcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcgttgggccactgaa

SEQ ID NO: 11424 - DNA, 455 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatccagcattgtgcagtactgcactgccttgttcattttgttagccttggccccgtgctggctcttggccactgaa

SEQ ID NO: 11425 - DNA, 436 bp, Artificial
  TaSBEIIa allele with mutations introduced by TALEN pair TaSBEIIa_T03
gagagatagctggattaggcgatcgcgcttcctgaacctgtattttttcccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcggagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 11426 - DNA, 265 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccgcggaggcgtcaggttttgagcttcttctatcagcattgtgcagtactgcactgccttgtgcattttgttagccgtggccccgtgctggctcttgggccactgaa

SEQ ID NO: 11427 - DNA, 440 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 11428 - DNA, 469 bp, Artificial
  TaSBEIIa allele with mutations introduced by TALEN pair TaSBEIIa_T03
gagagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcgttgggccactgaa

SEQ ID NO: 11429 - DNA, 450 bp, Artificial
  TaSBEIIa allele with mutations introduced by TALEN pair TaSBEIIa_T03
  misc_feature (209): n is a or c or t or g
gagagatagctggattaggcgatcgcgcttcctgaacctgtatttttttccccgcggggaaatgcgttagtgtcacccaggccctggtgttatcacggctttgatcatctcctcccattctgatattttctcactctttcttctgttcttgctgtaactgcaagttgtagcattgtctcactattgtagtcatccttgcattgcaggcnccgtcctgagcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccacgtgaa

SEQ ID NO: 11430 - DNA, 445 bp, Artificial; identical to SEQ ID NO: 10503
  TaSBEIIa allele with mutations introduced by TALEN pair TaSBEIIa_T03

SEQ ID NO: 11431 - DNA, 457 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgtcccggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 11432 - DNA, 474 bp, Artificial; identical to SEQ ID NO: 10710
  TaSBEIIa allele with mutations introduced by TALEN pair TaSBEIIa_T03

SEQ ID NO: 11433 - DNA, 479 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcgggaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttctctatcagcattgtgcagtactgcactgccttgttcattttgttagccttggccccgtgctggctcttgggccactgaa

SEQ ID NO: 11434 - DNA, 469 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcatttttgcaggcgccgtcctgagctggtgcctgacggcgagagcgacgacttggcaagtccggcgcaacctgaagaattacaggtacacacactcgtgccggtaaatcttcatacaatcgttattcacttaccaaatgccggatgaaaaccaaccacggatgcgtcaggtttcgagcttcttctatcagcattgtgcagtactgcactgccttgttcattttgttagtccttggccccgttgctggctcttgggccactgaa

SEQ ID NO: 11435 - DNA, 449 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 11436 - DNA, 442 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccagggtcctggtgcctgacggtgagagcgacgacttggcaagtccggcgcaacctgaagaattacaggtacactccatcgtgccgggaaatcttcatacaatcgttattcacttaccaaatgccggatgaaaccaagccgcggaggcgtcaggttttgagcttcttctatcagcattgtgcagtactgcactgccttgttcattttgttagccttggccccgtgctggctcttgggccactgaa

SEQ ID NO: 11437 - DNA, 468 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagccttggccccgtgctggtcttttgggccactgaa

SEQ ID NO: 11438 - DNA, 378 bp, Artificial
  TaSBEIIa allele with mutations introduced by TALEN pair TaSBEIIa_T03
gagagtagctggattaggcgatcgcctgcgtcagtgtcacccaggccctggtgttatcacggcttgatcatctcctcccattctgatattttctcactctttcttctgttcttgctgtaactgcaagttgtagcattgtctcactattgtagtcatccttgcattgcaggcgccaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 11439 - DNA, 464 bp, Artificial
  TaSBEIIa allele with mutations introduced by TALEN pair TaSBEIIa_T03
gagagatagctggattaggcgatcgcgcttcctgaacctgttattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctgcgagagcgacgacttggcaagtccggcgcaacctgaagaattacaggtacacacactcgtgccggtaaatcttcatacaatcgttattcacttaccaaatgccggatggaaaccaccacggatgcgtcaggtttcgagcttcttctatcagcattgtgcagtactgcactgccttgttcattttgttagccttggccccgtgctggctcttgggccactgaa

SEQ ID NO: 11440 - DNA, 459 bp, Artificial
  TaSBEIIa allele with mutations introduced by TALEN pair TaSBEIIa_T03
gagagatagctggattaggcgatcgcgcttcctgaacctgttattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggttttcgagcttcttctatcagcattgtgcagtactgcactgccttgttcattttgttagccttggccccgtgctggctcttgggccactgaa

SEQ ID NO: 11441 - DNA, 406 bp, Artificial
  TaSBEIIa allele with mutations introduced by TALEN pair TaSBEIIa_T03
gagagatagctggattaggcgatcgcctgcgtcagtgtcacccaggccctggtgttaccacggctttgatcattcctcgtttcattctgatatatattttctcactcttttcttcctgttcttgctgtaactgcaagttgtggcgttttttcactattgtagtcatccttgcattttgcatgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcatttgtagccttggccccgtgctggctcttgggccactgaa

SEQ ID NO: 11442 - DNA, 464 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcgcctgacggcgagagcgacgacttggcaagtccggcgcaacctgaagaattacaggtacacacactcgtgccggtaaatcttcatacaatcgttattcacttaccaaatgccggatgaaaccacacggatgcgtcaggtttcgagcttcttctatcagcattgtgcagtactgcactgccttgttcattttgttagccttggccccgtgctggctcttgggccactgaa

SEQ ID NO: 11443 - DNA, 485 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 11444 - DNA, 465 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 11445 - DNA, 436 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctcctggtgccctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 11446 - DNA, 448 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgcctgacggcgagagcgacgacttggcaagtccggcgcaacctgaagaattacaggtacacacactcgtgccggtaaatcttcatacaatcgttatcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 11447 - DNA, 467 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagctggtgcctgacggcgagagcgacgacttggcaagtccggcgcaacctgaagaattacaggtacacacactcgtgccggtaaatcttacatacaatcgttattcacttaccaaatgccggatgaaaaccaaccacggatgcgtcaggtttcgagcttcttctatcagcattgtgcagtactgcactgccttgtctattttgttagccttggccccgtgcctggctctgggccactgaa

SEQ ID NO: 11448 - DNA, 458 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcgcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 11449 - DNA, 459 bp, Artificial; identical to SEQ ID NO: 11190
  TaSBEIIa allele with mutations introduced by TALEN pair TaSBEIIa_T03

SEQ ID NO: 11450 - DNA, 430 bp, Artificial; identical to SEQ ID NO: 10709
  TaSBEIIa allele with mutations introduced by TALEN pair TaSBEIIa_T03

SEQ ID NO: 11451 - DNA, 395 bp, Artificial
  TaSBEIIa allele with mutations introduced by TALEN pair TaSBEIIa_T03
gagagatagctggattaggcgatcgcctcaggccctggtgttaccacggctttgatcatctcctcccattctgatattttctcactctttcttctgttcttgctgtaactgcaagttgtagcatttttttggcaaataagttgtagcattgtctcagtattgtactcatccttgcatttgcaggcgccgccactccagcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 11452 - DNA, 462 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 11453 - DNA, 449 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagagcgacgacttggcaagtccggcgcaacctgaagaattacaggtacacacactcgtgccggtaaatcttcatacaatcgttattcacttaccaaatgaccggatgaaaccaaccacggatgcgtcaggttttcgagcttcttctatcagcattgtgcagtactgcactgccttgttcattttgttagccttggccccgtgctggctcttgggccactgaa

SEQ ID NO: 11454 - DNA, 485 bp, Artificial; identical to SEQ ID NO: 8782
  TaSBEIIa allele with mutations introduced by TALEN pair TaSBEIIa_T03

SEQ ID NO: 11455 - DNA, 247 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctaatcgttattcacttaccaaatgccggatgaaaccaaccacggatgcgtcaggtttcgagcttcttctatcagcattgtgcagtactgcactgccttgttcattttgttagcctttggccccgtgctggctcttgggccactgaa

SEQ ID NO: 11456 - DNA, 458 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggcactgaa

SEQ ID NO: 11457 - DNA, 431 bp, Artificial; identical to SEQ ID NO: 10787
  TaSBEIIa allele with mutations introduced by TALEN pair TaSBEIIa_T03

SEQ ID NO: 11458 - DNA, 441 bp, Artificial
  TaSBEIIa allele with mutations introduced by TALEN pair TaSBEIIa_T03
gagagatagctggattaggcgatcgcgcttcctgaacctgtattttttcccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcagacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 11459 - DNA, 431 bp, Artificial; identical to SEQ ID NO: 10179
  TaSBEIIa allele with mutations introduced by TALEN pair TaSBEIIa_T03

SEQ ID NO: 11460 - DNA, 470 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggtgcctgacggcgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgcgctggctcttgggccactgaa

SEQ ID NO: 11461 - DNA, 430 bp, Artificial; identical to SEQ ID NO: 10283
  TaSBEIIa allele with mutations introduced by TALEN pair TaSBEIIa_T03

SEQ ID NO: 11462 - DNA, 435 bp, Artificial; identical to SEQ ID NO: 10444
  TaSBEIIa allele with mutations introduced by TALEN pair TaSBEIIa_T03

SEQ ID NO: 11463 - DNA, 202 bp, Artificial
  TaSBEIIa allele with mutations introduced by TALEN pair TaSBEIIa_T03
gagagatagctggattaggcgatcgcctgcgtcagtgtcacccaggccctttcatacaatcgttattcacttaccaaatgccggatgaaaccaagccgcggaggcatcaggtttcaagcttcttctatcagcattgtgcactacttcactgccttgtgcagtttgttagctgtggccccgcgctggctcttgggccactgaa

SEQ ID NO: 11464 - DNA, 264 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccgcggaggcgtcaggttttgagcttcttctatcagcattgtgcagtactgcactgccttgtgcattttgttagccgtggccccgtgctggctcttggccactgaa

SEQ ID NO: 11465 - DNA, 265 bp, Artificial; identical to SEQ ID NO: 11426
  TaSBEIIa allele with mutations introduced by TALEN pair TaSBEIIa_T03

SEQ ID NO: 11466 - DNA, 347 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggtacacaccatcgtgccgggaaatcttcatacaatcgttattcacttaccaaatgccggatgaaaccaagccgcggaggcgtcaggtttgagcttcttctatcagcattgtgcagtactgcactgccttgtgcattttgttagccgtggccccgtgctggctcttgggccactgaa

SEQ ID NO: 11467 - DNA, 447 bp, Artificial; identical to SEQ ID NO: 10239
  TaSBEIIa allele with mutations introduced by TALEN pair TaSBEIIa_T03

SEQ ID NO: 11468 - DNA, 474 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctggtgcctgacggcgagagcgacgacttggcaagtccggcgcaacctgaagaattacaggtacacacactcgtgccggtaaatcttacatacaatcgttattcacttaccaaatgccggatgaaaccaaccacggatgcgtcaggtttcgagcttcttctatcagcattgtgcagtactgcactgccttgttcattttgtagccttggccccgtgctggctcttgggccactgaa

SEQ ID NO: 11469 - DNA, 195 bp, Artificial; identical to SEQ ID NO: 9876
  TaSBEIIa allele with mutations introduced by TALEN pair TaSBEIIa_T03

SEQ ID NO: 11470 - DNA, 481 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttctctatcagcattgtgcagtactgcactgccttgttcattttgttagccttggccccgcgctggctcgttcgggccactgaa

SEQ ID NO: 11471 - DNA, 479 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtacctgcactgccttgttcattttgttagccttggccccgtgctggctcttgggccactgaa

SEQ ID NO: 11472 - DNA, 470 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgccctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagctcttctatcagcattgtgcagtactgcactgccttgttcattttgttagccttggccccgtgctggctcttgggccactgaa

SEQ ID NO: 11473 - DNA, 202 bp, Artificial; identical to SEQ ID NO: 9791
  TaSBEIIa allele with mutations introduced by TALEN pair TaSBEIIa_T03

SEQ ID NO: 11474 - DNA, 441 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctgggaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgttagccgtggccccgtgctggctctgggccactgaa

SEQ ID NO: 11475 - DNA, 483 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcgggggaaggtcctggtgcctgacggcgagagcgacgacttggcaagtccggcgcaacctgaaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 11476 - DNA, 390 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgttagccgtggccccgtgctggctcttgggccactgaa

SEQ ID NO: 11477 - DNA, 336 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgcctggctcttgggccactgaa

SEQ ID NO: 11478 - DNA, 465 bp, Artificial
  TaSBEIIa allele with mutations introduced by TALEN pair TaSBEIIa_T03
gagagatagctggattaggcgatcgcgcttcctgaacctgtattttttcccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgcctggctcttgggccactgaa

SEQ ID NO: 11479 - DNA, 443 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccagggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgaggcttcttctatcagcattgtgcagtactgcactgccttgtgctattttgtagccgtggccccgtgctggctcttgggccactgaa

SEQ ID NO: 11480 - DNA, 439 bp, Artificial
  TaSBEIIa allele with mutations introduced by TALEN pair TaSBEIIa_T03
gagagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcattgcaggcgccgtcctgagccgcgcggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagtcttcttctatcagcattgtgcagtactgcactgccttgtgcattttgtagccgtggccccgtgctggctcttgggccactgaa

SEQ ID NO: 11481 - DNA, 481 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtgcctgacggcgagagcgacgacttggcaagtccggcgcaacctgaagaattaccggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagccttggccccgtgctggctcgttgggccactgaa

SEQ ID NO: 11482 - DNA, 478 bp, Artificial; identical to SEQ ID NO: 8889
  TaSBEIIa allele with mutations introduced by TALEN pair TaSBEIIa_T03

SEQ ID NO: 11483 - DNA, 471 bp, Artificial; identical to SEQ ID NO: 11111
  TaSBEIIa allele with mutations introduced by TALEN pair TaSBEIIa_T03

SEQ ID NO: 11484 - DNA, 413 bp, Artificial
  TaSBEIIa allele with mutations introduced by TALEN pair TaSBEIIa_T03
gagagatagctggattaggcgatcgcctgcgtcagtgtcacccaggccctggtgttaccacggctttgatcattcctcgtttcattctgatatatattttctcactctttttcttcctgttcttgctgtaactgcaagttgtggcgttttttcactattgtagtcatccttgcattttggtgcctgacggcgagagcgacgacttggcaagtccggcgcaacctgaagaattacaggtacacacactcgtgccggtaaatcttcatacaatcgttattcacttaccaaatgccggatgaaaaccaaccacggatgcgtcaggtttcgagcttctctatcagcattgtgcagtactgcactgcccttgttcattttgttagccttggccccgtgctggctcttgggccactgaa

SEQ ID NO: 11485 - DNA, 378 bp, Artificial
  TaSBEIIa allele with mutations introduced by TALEN pair TaSBEIIa_T03
  misc_feature (357): n is a or c or t or g
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagcaacctgaagaattacaggtacacaccatcgtgccgggaaatcttcatacaatcgttattcacttaccaaatgccggatgaaaccaagccgcggaggcgtcaggttttgagcttcttctatcagcattgtgcactacttcactgccttgtgcagtttgttagctgtggcccgngctggctcttgggccactgaa

SEQ ID NO: 11486 - DNA, 465 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 11487 - DNA, 476 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccggaaggtcctggtgcctgacggcgagagcgacgacttggcaagtccggcgcaacctgaagaattacaggtacacacactcgtgccggtaaatcttcatacaatcgttattcacttaccaaatgccggatgaaaaccaaccacggatgcgtcaggtttcgagcttctctatcagcattgtgcagtactgcactgccttgttcattttgttagccttggccccgttgctggctcttgggccactgaa

SEQ ID NO: 11488 - DNA, 439 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcgtccggcgcaacctgaagaattacaggtacacacactcgtgccggtaaatcttcatacaatcgttattcacttaccaaatgccggatgaaaccaaccacggatgcgtcaggttttcgagcttcttctatcagcattgtgcagtactgcactgccttgttcattttgttagccttggccccgtgctgggctcttgggccactgaa

SEQ ID NO: 11489 - DNA, 476 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctggtgcctgacggcgagagcgacgacttggcaagtccggcgcaacctgaagaattacaggtacacacactcgtgccggtaaatcttcatacaatcgttattcacttaccaaatgccggatgaaaaccaaccacggatgcgtcaggtttcgagcttcttctatcagcattgtgcagtactgcactgccttgttcattttgttagccttggccccgtgctggcttcttgggccactgaa

SEQ ID NO: 11490 - DNA, 474 bp, Artificial; identical to SEQ ID NO: 9013
  TaSBEIIa allele with mutations introduced by TALEN pair TaSBEIIa_T03

SEQ ID NO: 11491 - DNA, 337 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcatctcctcccattctgatattttctcactctttcttctgttcttgctgtaattacaggtacacaccatcgtgccgggaaatcttcatacaatcgttattcacttaccaaatgccggatgaaaccaaccacggatgcgtcaggtttcgagcttcttctatcagcattgtgcagtactgcactgccttgttcattttgttagccttggcccgtgctggctcgttggccactgaa

SEQ ID NO: 11492 - DNA, 399 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgtagccgtggccccgtgctggctcgttgggccactgaa

SEQ ID NO: 11493 - DNA, 436 bp, Artificial; identical to SEQ ID NO: 10350
  TaSBEIIa allele with mutations introduced by TALEN pair TaSBEIIa_T03

SEQ ID NO: 11494 - DNA, 468 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagtcttcttctatcagcattgtgcagtactgcactgccttgttcattttgttagccttggccccgtgctggctcttgggccactgaa

SEQ ID NO: 11495 - DNA, 435 bp, Artificial
  TaSBEIIa allele with mutations introduced by TALEN pair TaSBEIIa_T03
gagagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccatgaa

SEQ ID NO: 11496 - DNA, 466 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcatttttgcaggcgccgtcctgagccgcgcgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 11497 - DNA, 487 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggtcctggtgcctgacggcgagagcgacgacttggcaagtccggcgcaacctgaagaattacaggtacacacactcgtgccggtaaaatcttcatacaatcgttattcacttaccaaatgccggatgaaaaccaaccacggatgcgtcaggtttcgagcttcttctatcagcattgtgcagtactgcactgccttgttcattttgtagccttggccccgtgctggctcttgggccactgaa

SEQ ID NO: 11498 - DNA, 470 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgggaaggtcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 11499 - DNA, 262 bp, Artificial; identical to SEQ ID NO: 9893
  TaSBEIIa allele with mutations introduced by TALEN pair TaSBEIIa_T03

SEQ ID NO: 11500 - DNA, 446 bp, Artificial
  TaSBEIIa allele with mutations introduced by TALEN pair TaSBEIIa_T03
  misc_feature (380): n is a or c or t or g
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgngcagtactgcactgccttgttcattttgttagccttggccccgtgcctggctcttgggccactgaa

SEQ ID NO: 11501 - DNA, 387 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgacgacttggcaagtccggcgcaacctgaagaattacaggtacacaccatcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 11502 - DNA, 375 bp, Artificial
  TaSBEIIa allele with mutations introduced by TALEN pair TaSBEIIa_T03
  misc_feature (330): n is a or c or t or g
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgngctattttgtagccgtggccccgtgctggctcttgggccactgaa

SEQ ID NO: 11503 - DNA, 458 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctggtgcctgacggcgagagcgacgacttggcaagtccggcgcaacctgaagaattacaggtacacacactcgtgccggtaaatcttcatacaatcgttatcacttaccaaatgccggatgaaaccaaccacggatgcgtcaggtttcgagcttcttctatcagcattgtgcagtactgcactgccttgttcattttgttagccttggccccgtgctgctcttgggccactgaa

SEQ ID NO: 11504 - DNA, 461 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgttcccggtgcctgacggcgagagcgacgacttggcaagtccggcgcaacctgaagaattacaggtacacacactcgtgccggtaaatcttcatacaatcgttatcacttaccaaatgccggatgaaaccaaccacggatgcgtcaggtttcgagcttcttctatcagcattgtgcagtactgcactgccttgttcattttgttagccttggcccccgtgctggctcttgggccactgaa

SEQ ID NO: 11505 - DNA, 481 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcctggtgcctgacggcgagagcgacgacttggcaagtccggcgcaacctgaagaattacaggtacacacactcgtgccggtaaatcttcatacaatcgttattcacttaccaaatgccggatgaaaaccaaccacggatgcgtcaggtttcgagcttcttctatcagcattgtgcagtactgcactgccttgttctattttgttagccttggccccgtgctggctcttgggccactgaa

SEQ ID NO: 11506 - DNA, 484 bp, Artificial; identical to SEQ ID NO: 9104
  TaSBEIIa allele with mutations introduced by TALEN pair TaSBEIIa_T03

SEQ ID NO: 11507 - DNA, 417 bp, Artificial; identical to SEQ ID NO: 11252
  TaSBEIIa allele with mutations introduced by TALEN pair TaSBEIIa_T03

SEQ ID NO: 11508 - DNA, 425 bp, Artificial
  TaSBEIIa allele with mutations introduced by TALEN pair TaSBEIIa_T03
gagagatagctggattaggcgatcgcgcttcctgaacctgtattttttccccgtcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgccgacgacttggcaagtccggcgcaacctgaagaattacaggtacacacactcgtgccggtaaatcttcatacaatcgttattcacttaccaaatgccggatgaaaccaaccacggatgcgtcaggttttcgagcttcttctatcagcattgtgcagtactgcactgccttgttcattttgttagccttggccccgtgctggctcttgggccactgaa

SEQ ID NO: 11509 - DNA, 457 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccccggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 11510 - DNA, 473 bp, Artificial; identical to SEQ ID NO: 10909
  TaSBEIIa allele with mutations introduced by TALEN pair TaSBEIIa_T03

SEQ ID NO: 11511 - DNA, 454 bp, Artificial
  TaSBEIIa allele with mutations introduced by TALEN pair TaSBEIIa_T03
gagagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcgggaaggtcctggtgcctgacggtgagagcgacgacttggcggccactccagcgcaaacccgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 11512 - DNA, 416 bp, Artificial; identical to SEQ ID NO: 9823
  TaSBEIIa allele with mutations introduced by TALEN pair TaSBEIIa_T03

SEQ ID NO: 11513 - DNA, 449 bp, Artificial
  TaSBEIIa allele with mutations introduced by TALEN pair TaSBEIIa_T03
gagagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 11514 - DNA, 266 bp, Artificial
  TaSBEIIa allele with mutations introduced by TALEN pair TaSBEIIa_T03
  misc_feature (174): n is a or c or t or g
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcncgtctgagcctgacggtcagtcgacgggaacggtccttgggcaacgttcggacggtcgaaccgtggacgaacgttacctagggtaccaacgt

SEQ ID NO: 11515 - DNA, 436 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcgttgggccacgtgaa

SEQ ID NO: 11516 - DNA, 388 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgacgacttggcaagtccggcgcaacctgaagaattacaggtacacaccatcgtgccggtaaatcttcatacaatcgttattcacttaccaaatgccggatgaaaccaaccacggatgcgtcaggtttcgagctttcttctatcagcattgtgcagtactgcactgccttgttcatttgttagccttggccccgtgctggctcttgggccactgaa

SEQ ID NO: 11517 - DNA, 373 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttggggccactgaa

SEQ ID NO: 11518 - DNA, 386 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggccgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgatggctcttgggccactgaa

SEQ ID NO: 11519 - DNA, 475 bp, Artificial
  TaSBEIIa allele with mutations introduced by TALEN pair TaSBEIIa_T03
atagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcgggaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggcactgaa

SEQ ID NO: 11520 - DNA, 480 bp, Artificial; identical to SEQ ID NO: 10186
  TaSBEIIa allele with mutations introduced by TALEN pair TaSBEIIa_T03

SEQ ID NO: 11521 - DNA, 409 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattttgcagggtgcctgacggcgagagcgacgacttggcaagtccggcgcaacctgaagaattacaggtacacacactcgtgccggtaaatcttcatacaatcgttattcacttaccaaaatgccggatgaaaccaaccacggatgcgtcaggtttcgagcttcttctatcagcattgtgcagtactgcactgccttgttcattttgttagccttggccccgtgctgggctcttgggccactgaa

SEQ ID NO: 11522 - DNA, 480 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggccctggtgcctgacggcgagagcgacgacttggcaagtccggcgcaacctgaagaattacaggtacacacactcgtgccggtaaaatcttcatacaatcgttattcacttaccaaatgccggatgaaaccaaccacggatgcgtcaggtttcgagcttcttctatcagcattgtgcagtactgcacctgccttgttcattttgttagccttggccccgttgcttggctctttgggccactgaa

SEQ ID NO: 11523 - DNA, 327 bp, Artificial; identical to SEQ ID NO: 10113
  TaSBEIIa allele with mutations introduced by TALEN pair TaSBEIIa_T03

SEQ ID NO: 11524 - DNA, 420 bp, Artificial; identical to SEQ ID NO: 11106
  TaSBEIIa allele with mutations introduced by TALEN pair TaSBEIIa_T03

SEQ ID NO: 11525 - DNA, 289 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 11526 - DNA, 479 bp, Artificial; identical to SEQ ID NO: 8885
  TaSBEIIa allele with mutations introduced by TALEN pair TaSBEIIa_T03

SEQ ID NO: 11527 - DNA, 473 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggtggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttctctatcagcattgtgcagtactgcactgccttgttcattttgttagtccttggccccgttgctggctcgttgggccactgaa

SEQ ID NO: 11528 - DNA, 471 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 11529 - DNA, 464 bp, Artificial; identical to SEQ ID NO: 10193
  TaSBEIIa allele with mutations introduced by TALEN pair TaSBEIIa_T03

SEQ ID NO: 11530 - DNA, 483 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcgtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgtgcatttttgttagccgtggccccgtgctggctcttgggccactgaa

SEQ ID NO: 11531 - DNA, 436 bp, Artificial
  TaSBEIIa allele with mutations introduced by TALEN pair TaSBEIIa_T03
  misc_feature (203): n is a or c or t or g
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctctggtncctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgttagccgtggccccgtgctggctcttgggccacgtgaa

SEQ ID NO: 11532 - DNA, 427 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcatttgcaggcgccgtcctgaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggccactgaa

SEQ ID NO: 11533 - DNA, 423 bp, Artificial
  TaSBEIIa allele with mutations introduced by TALEN pair TaSBEIIa_T03
gagagatagctggattaggcgatcgcctcaggccctggtgttaccacggctttgatcatctcctcgtttcattctgatatatattttctcactctttttcttcctgttcttgctgtaactgcaagttgtggcgttttttcactattgtagtcatccttgcattttgcaggcgccgtcctgagccgcctggtgcctgacggcgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagctgtggccccgcgctggctcttgggccactgaa

SEQ ID NO: 11534 - DNA, 305 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaattacaggtacacaccatcgtgccgggaatcttcatacaatcgttattcacttaccaaatgccggatgaaaccaagccgcggaggcgtcaggttttgagcttcttctatcagcattgtgcagtactgcactgccttgtgctattttgttagccgtggccccgtgctggctcttgggccactgaa

SEQ ID NO: 11535 - DNA, 401 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagcccactcgtgccggtaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 11536 - DNA, 377 bp, Artificial; identical to SEQ ID NO: 11092
  TaSBEIIa allele with mutations introduced by TALEN pair TaSBEIIa_T03

SEQ ID NO: 11537 - DNA, 443 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccagggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgcctggctcttgggccacgtgaa

SEQ ID NO: 11538 - DNA, 449 bp, Artificial; identical to SEQ ID NO: 10033
  TaSBEIIa allele with mutations introduced by TALEN pair TaSBEIIa_T03

SEQ ID NO: 11539 - DNA, 366 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcatctcctcccattctgatattttctcactctttcttctgttcttgctgtaactgcaagttgtagcattgctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgttagccgtggccccgtgctggctcttgggccactgaa

SEQ ID NO: 11540 - DNA, 452 bp, Artificial; identical to SEQ ID NO: 10992
  TaSBEIIa allele with mutations introduced by TALEN pair TaSBEIIa_T03

SEQ ID NO: 11541 - DNA, 477 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgggaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagtccttggccccgtgctggctcttgggccactgaa

SEQ ID NO: 11542 - DNA, 450 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 11543 - DNA, 448 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcagcttcttctatcagcattgtgcagtactgcactgccttgttcattttgttagccttggccccgtgctggctcttgggccactgaa

SEQ ID NO: 11544 - DNA, 444 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggccagtccggcgcaacctgaagaattacaggtacacacactcgtgccggtaaatcttcatacaatcgttattcacttaccaaatgccggatgaaaccaaccacggatgcgtcaggttttcgagcttcttctatcagcattgtgcagtactgcactgccttgttcattttgttagccttggcccccgtgctggctcttgggccactgaa

SEQ ID NO: 11545 - DNA, 453 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgcctggctcttgggccactgaa

SEQ ID NO: 11546 - DNA, 467 bp, Artificial
  TaSBEIIa allele with mutations introduced by TALEN pair TaSBEIIa_T03
gagagatagctggattgcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctcctgacggcgagagcgacgacttggcaagtccggcgcaacctgaagaattacaggtacacacactcgtgccggtaaatctcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 11547 - DNA, 486 bp, Artificial; identical to SEQ ID NO: 8818
  TaSBEIIa allele with mutations introduced by TALEN pair TaSBEIIa_T03

SEQ ID NO: 11548 - DNA, 440 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgtagccttggccccgtgctggctcttgggccactgaa

SEQ ID NO: 11549 - DNA, 437 bp, Artificial
  TaSBEIIa allele with mutations introduced by TALEN pair TaSBEIIa_T03
gagagatagctggattaggcgatcgcgcttcctgaacctgtatttttttccccgcggggaaatgcgttagtgtcacccaggccctggtgttatcacggctttgatcatctcctcccattctgatattttctcactctttcttctgttcttgctgtaactgcaagttgtagcattgtctcactattgtagtcatccttgcattgcgtgcctgacggtgagagcgacgacttggcaagtccggcgcaacctgaagaattacaggtacacaccatcgtgccgggaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 11550 - DNA, 476 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgtagcctttggccccgttgctggctcttgggccactgaa

SEQ ID NO: 11551 - DNA, 465 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccgtggccccgtgctggctcttgggccactgaa

SEQ ID NO: 11552 - DNA, 456 bp, Artificial
  TaSBEIIa allele with mutations introduced by TALEN pair TaSBEIIa_T03
gagagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcattttgcaggcgccgtcctgagccgcgcggcctctccagggtcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 11553 - DNA, 443 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattttgcaggcgccgtcctgagccgcgcggcctctccagggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 11554 - DNA, 421 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagtggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgcctggctcttgggccactgaa

SEQ ID NO: 11555 - DNA, 335 bp, Artificial; identical to SEQ ID NO: 10414
  TaSBEIIa allele with mutations introduced by TALEN pair TaSBEIIa_T03

SEQ ID NO: 11556 - DNA, 431 bp, Artificial; identical to SEQ ID NO: 9914
  TaSBEIIa allele with mutations introduced by TALEN pair TaSBEIIa_T03

SEQ ID NO: 11557 - DNA, 457 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggttttcgagcttcttctatcagcattgtgcagtactgcactgccttgttcattttgttagccttggccccgtgctggctcttgggccactgaa

SEQ ID NO: 11558 - DNA, 416 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgaggcttcttctatcagcattgtgcagtactgcactgccttgtgcattttgttagccgtggcccccgtgctggctcttgggccactgaa

SEQ ID NO: 11559 - DNA, 407 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctgggctcttggccactgaa

SEQ ID NO: 11560 - DNA, 441 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 11561 - DNA, 459 bp, Artificial; identical to SEQ ID NO: 10509
  TaSBEIIa allele with mutations introduced by TALEN pair TaSBEIIa_T03

SEQ ID NO: 11562 - DNA, 486 bp, Artificial; identical to SEQ ID NO: 8818
  TaSBEIIa allele with mutations introduced by TALEN pair TaSBEIIa_T03

SEQ ID NO: 11563 - DNA, 381 bp, Artificial; identical to SEQ ID NO: 10765
  TaSBEIIa allele with mutations introduced by TALEN pair TaSBEIIa_T03

SEQ ID NO: 11564 - DNA, 480 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagccttggccccgtgctggctcttgggccactgaa

SEQ ID NO: 11565 - DNA, 416 bp, Artificial; identical to SEQ ID NO: 10470
  TaSBEIIa allele with mutations introduced by TALEN pair TaSBEIIa_T03

SEQ ID NO: 11566 - DNA, 440 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagtcttcttctatcagcattgtgcagtactgcactgccttgtgctattttgttagccgtggcccccgtgctggctcgttgggccacgtgaa

SEQ ID NO: 11567 - DNA, 200 bp, Artificial
  TaSBEIIa allele with mutations introduced by TALEN pair TaSBEIIa_T03
gagagatagctggattaggcgatcgcctgcgtcagtgtcacccaggcctcatacaatcgttattcacttaccaaatgccggatgaaaccaagccgcggaggcgtcaggttttgagcttcttctatcagcattgtgcaagtactgcactgccttgtgcattttgttagccgtggccccgtgctggctcttgggccactgaa

SEQ ID NO: 11568 - DNA, 436 bp, Artificial
  TaSBEIIa allele with mutations introduced by TALEN pair TaSBEIIa_T03
gagagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggttttcgagctttcttctatcagcattgtgcagtactgcactgccttgttcattttgttagccttggccccgtgctggctcttgggccactga

SEQ ID NO: 11569 - DNA, 475 bp, Artificial
  TaSBEIIa allele with mutations introduced by TALEN pair TaSBEIIa_T03
gagagatagctggattaggcgatcgcgcttcctgaacctgtatttttttccccgcggggaaatgcgttagtgtcacccaggccctggtgttaccacggctttgatcattcctcgttttcattctgatatatattttctcactctttttcttcctgttcttgctgtaactgcaagttgtggcgtttttttcactattgtagtcatccttgcatttttgcaggcgccgtcctgagccgcgcggcctcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggcc

SEQ ID NO: 11570 - DNA, 411 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 11571 - DNA, 411 bp, Artificial
  TaSBEIIa allele with mutations introduced by TALEN pair TaSBEIIa_T03
gagagatagcctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcgagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 11572 - DNA, 415 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtccggtgcctgacggtgagagcgacgacttggcaagtccggcgcaacctgaagaattacaggtacacaccatcgtgtcgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 11573 - DNA, 490 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggtcctggtgcctgacggcgagagcgacgacttggcaagtccggcgcaacctgaagaattacaggtacacacactcgtgccggtaaatcttcatacaatcgttattcacttaccaaatgccggatgaaaaccaaccacggatgcgtcaggtttcgagcttcttctatcagcattgtgcagtactgcactgccttgttcattttgttagtccttggccccgttgctgggctcttgggccactgaa

SEQ ID NO: 11574 - DNA, 466 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcgcctgacggcgagagcgacgacttggcaagtccggcgcaacctgaagaattacaggtacacacactcgtgccggtaaatcttcatacaatcgttattcacttaccaaatgccgaatgaaaccaaccacggatgcgtcaggtttcgagcttcttctatcagcattgtgcagtactgcactgccttgttcattttgttagccttggccccgtgctggctcttgggccactgaa

SEQ ID NO: 11575 - DNA, 408 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 11576 - DNA, 378 bp, Artificial
  TaSBEIIa allele with mutations introduced by TALEN pair TaSBEIIa_T03
gagagatagctgggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 11577 - DNA, 466 bp, Artificial
  TaSBEIIa allele with mutations introduced by TALEN pair TaSBEIIa_T03
gagagatagctggattaggcgatcgcgcttcctgaacctgtattttttcccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtgtcatccttgcattttgcaggcgccgtcctgagccgcgcgtgcctgacggcgagagcgacgacttggcaagtccggcgcaacctgaagaattacaggtacacacactcgtgccggtaaatcttcatacaatcgttattcacttaccaatgccggatgaaaccaccacggatgcgtcaggtttcgagcttcttctatcagcattgtgcagtactgcactgccttgttctattttgttagtccttggccccgtgctggctcttgggccactgaa

SEQ ID NO: 11578 - DNA, 451 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcgacgacttggcaagtccggcgcaacctgaagaattacaggtacacacactcgtgccggtaaatcttcatacaatcgttattcacttaccaaatgccggatgaaaccaacacggatgcgtcaggtttcgagcttcttctatcagcattgtgcagtactgcactgccttgttcattttgttagcctttggcccccgtgctggctcttgggccactgaa

SEQ ID NO: 11579 - DNA, 304 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactaccttcatacaatcgttattcacttaccaaatgccggatgaaaccaagccgcggaggcgtcaggttttgagcttcttctatcagcattgtgcagtactgcactgccttgtgcattttgttagccgtggcccgtgcttttggctcttgggccactgaa

SEQ ID NO: 11580 - DNA, 468 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggttttcgagcttcttctatcagcattgtgcagtactgcactgccttgttcattttgttagccttggccccgtgctggctcgttgggccactgaa

SEQ ID NO: 11581 - DNA, 474 bp, Artificial
  TaSBEIIa allele with mutations introduced by TALEN pair TaSBEIIa_T03
gagagatagctggattaggcgatcgcgcttcctgaacctgttattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctgtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagccttggccccgtgctggctcttgggccactga

SEQ ID NO: 11582 - DNA, 195 bp, Artificial; identical to SEQ ID NO: 9876
  TaSBEIIa allele with mutations introduced by TALEN pair TaSBEIIa_T03

SEQ ID NO: 11583 - DNA, 357 bp, Artificial
  TaSBEIIa allele with mutations introduced by TALEN pair TaSBEIIa_T03
gagagatagctggattaggcgatcgcctgcgtcagtgtcacccaggccctggtgttaccacggctttgatcattcctcgtttcattctgatatatattttctcactcttttcttcctgttcttgctgtaactgcaagttgtggcgttttttcactattgtagtcatccttgcattttgcaggcgccgtcactcgtgccggtaaatcttcatacaatcgttattcacttaccaaatgccggatgaaaccaaccacggatgcgtcaggtttcgagcttcttctatcagcattgtgcagtactgcactgccttgttcattttgtagccttggccccgtgctggctcttgggccactgaaa

SEQ ID NO: 11584 - DNA, 471 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgggtcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 11585 - DNA, 388 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttgttagccgtggccccgtgctggctcttgggccactgaa

SEQ ID NO: 11586 - DNA, 274 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 11587 - DNA, 406 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatatttctcactctttcttctgttcttgctgtaactgcaagttgtagcattgtctcactattgtagtcatccttgcattgcaggcgccgtcctgagccgcgcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctgggctcttgggccactgaa

SEQ ID NO: 11588 - DNA, 441 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgagagcgacgacttggcaagtccggcgcaacctgaagaattacaggtacacacactcgtgccggtaaatcttcatacaatcgttattcacttaccaaatgccggatgaaaccaaccacggatgcgtcaggtttcagcttcttctatcagcattgtgcagtactgcactgccttgttcattttgttagccttggccccgtgctggctcttgggccactgaa

SEQ ID NO: 11589 - DNA, 247 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcatacaatcgttattcacttaccaaatgccggatgaaaccaagccgcggaggcgtcaggttttgagcttcttctatcagcattgtgcagtactgcactgccttgtgctattttgttagccgtggccccgtgctggctcttgggccactgaa

SEQ ID NO: 11590 - DNA, 262 bp, Artificial; identical to SEQ ID NO: 9893
  TaSBEIIa allele with mutations introduced by TALEN pair TaSBEIIa_T03

SEQ ID NO: 11591 - DNA, 486 bp, Artificial; identical to SEQ ID NO: 8818
  TaSBEIIa allele with mutations introduced by TALEN pair TaSBEIIa_T03

SEQ ID NO: 11592 - DNA, 469 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 11593 - DNA, 381 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcggcaagtccggcgcaacctgaagaattacaggtacacaccatcgtgccgggaaatcttcatacaatcgttattcacttaccaaatgccggatgaaaccaagccgcggaaggcgtcaggttttgagcttcttctatcagcattgtgcagtactgcactgccttgtgcattttgtagccgtggccccgtgctggctcttgggccactgaa

SEQ ID NO: 11594 - DNA, 479 bp, Artificial; identical to SEQ ID NO: 9018
  TaSBEIIa allele with mutations introduced by TALEN pair TaSBEIIa_T03

SEQ ID NO: 11595 - DNA, 458 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagcgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggttttcgagcttcttctatcagcattgtgcagtactgcactgccttgttcattttgttagccttggccccgtgctggctcttgggccactgaa

SEQ ID NO: 11596 - DNA, 431 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctcggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcgttgggccactgaa

SEQ ID NO: 11597 - DNA, 462 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcatttttgcaggcgccgtcccctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttggccactgaa

SEQ ID NO: 11598 - DNA, 395 bp, Artificial
  TaSBEIIa allele with mutations introduced by TALEN pair TaSBEIIa_T03
gagagatagctggattaggcgatcgcctgcgtcagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgtagccttggccccgtgctggctcttggggccactgaa

SEQ ID NO: 11599 - DNA, 486 bp, Artificial; identical to SEQ ID NO: 8861
  TaSBEIIa allele with mutations introduced by TALEN pair TaSBEIIa_T03

SEQ ID NO: 11600 - DNA, 331 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcagggaaatcttcatacaatcgttattcacttaccaaatgccggatgaaaccaagccgcggaggcgtcaggttttgagcttcttctatcagcattgtgcagtactgcactgccttgttcattttgttagcctttggccccgtgctggctcttgggccactgaa

SEQ ID NO: 11601 - DNA, 381 bp, Artificial; identical to SEQ ID NO: 10765
  TaSBEIIa allele with mutations introduced by TALEN pair TaSBEIIa_T03

SEQ ID NO: 11602 - DNA, 472 bp, Artificial; identical to SEQ ID NO: 10330
  TaSBEIIa allele with mutations introduced by TALEN pair TaSBEIIa_T03

SEQ ID NO: 11603 - DNA, 467 bp, Artificial; identical to SEQ ID NO: 9077
  TaSBEIIa allele with mutations introduced by TALEN pair TaSBEIIa_T03

SEQ ID NO: 11604 - DNA, 350 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattacaggtacacaccatcgtgccgggaaatcttcatacaatcgttattcacttaccaaatgccggatgaaaccaagccgcggaggcgtcaggttttgagcttcttctatcagcattgtgcactacttcactgccttgtgcagttttgttagctgtcggccccgcgctggctcttgggccactgaa

SEQ ID NO: 11605 - DNA, 253 bp, Artificial
  TaSBEIIa allele with mutations introduced by TALEN pair TaSBEIIa_T03
gagagatagctggattaggcgatcgcctcaggccctggtgttaccacggctttgatcatctcctcctttcatgctgatattttctcactctttcttctgttcttgctgtaactgcaagtcacttaccaaatatcggatgaaccaagccgcggaggcatcaggtttcaagcttcttctatcagcattgtgcactacttcactgccttgtgcagtttgttagctgtggccccgtgctggctcttgggccactgaa

SEQ ID NO: 11606 - DNA, 288 bp, Artificial
  TaSBEIIa allele with mutations introduced by TALEN pair TaSBEIIa_T03
  misc_feature (199); (235): n is a or c or t or g
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgtgcggtcagcgnggaacgtccttgggcacgttcggacggtcgaaccgngacgaacgttacctagggaccaaacgtcccggagtccgtaacgtccgggaaaa

SEQ ID NO: 11607 - DNA, 449 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccctgacggtgagagcgacgacttggcaagtccggcgcaacctgaagaattacaggtacacaccatcgtgccgggaaatctcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 11608 - DNA, 350 bp, Artificial
  TaSBEIIa allele with mutations introduced by TALEN pair TaSBEIIa_T03
gagagatagctggattaggcgatcgcctgcgtcagtgtcacccaggccctggtgttaccacggctttgatcattcctcgtttcattctgatatatattttctcactctttttcttcctgttcttgctgtaactgcaagttgtggtcgttttttcactattgtagtcatccttgcattttgcaggcgccgtcctaaatcttcatacaatcgttattcacttaccaaatgccggatgaaaccaagccgcggaggcgtcaggttttgagcttcttctatcagcattgtgcagtactgcactgccttgtgctattttgtagccgtggccccgtgctggctcttgggccactgaa

SEQ ID NO: 11609 - DNA, 485 bp, Artificial; identical to SEQ ID NO: 10801
  TaSBEIIa allele with mutations introduced by TALEN pair TaSBEIIa_T03

SEQ ID NO: 11610 - DNA, 471 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgccctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactga

SEQ ID NO: 11611 - DNA, 302 bp, Artificial; identical to SEQ ID NO: 10343
  TaSBEIIa allele with mutations introduced by TALEN pair TaSBEIIa_T03

SEQ ID NO: 11612 - DNA, 469 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgggaaggtcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgtagccttggccccgtgctggctcttgggccactgaa

SEQ ID NO: 11613 - DNA, 303 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactaccttcatacaatcgttattcacttaccaaatgccggatgaaaccaagccgacggaggcgtcaggttttgagcttcttctatcagcattgtgcagtactgcactgccttgtgcattttgttagccgtggccccgtgctggctcttgggccactgaa

SEQ ID NO: 11614 - DNA, 423 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagtcttcttctatcagcattgtgcagtactgcactgccttgtgcattttgtagccgtggccccgtgctggctcttgggccactgaa

SEQ ID NO: 11615 - DNA, 317 bp, Artificial
  TaSBEIIa allele with mutations introduced by TALEN pair TaSBEIIa_T03
gagagatagctggattaggcgatcgcctgcgtcagtgtcacccaggccctggtgttaccacggctttgatcattcctcgtttcattctgatatatattttctcactctttttcttcctgttcttgctgtaactgcaagttgtggcgttttttcactattgtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 11616 - DNA, 407 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgcctttgtgcattttgttagccgtggccccgtgctggctcttgggccactgaa

SEQ ID NO: 11617 - DNA, 442 bp, Artificial; identical to SEQ ID NO: 11436
  TaSBEIIa allele with mutations introduced by TALEN pair TaSBEIIa_T03

SEQ ID NO: 11618 - DNA, 451 bp, Artificial
  TaSBEIIa allele with mutations introduced by TALEN pair TaSBEIIa_T03
gagagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 11619 - DNA, 374 bp, Artificial; identical to SEQ ID NO: 11185
  TaSBEIIa allele with mutations introduced by TALEN pair TaSBEIIa_T03

SEQ ID NO: 11620 - DNA, 451 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgtcattttgttagccttggccccgtgctggctcttgggccactgaa

SEQ ID NO: 11621 - DNA, 455 bp, Artificial
  TaSBEIIa allele with mutations introduced by TALEN pair TaSBEIIa_T03
gagagatagctggattaggcgatcgcgcttcctgaacctgtattttttcccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctctgggccactgaa

SEQ ID NO: 11622 - DNA, 417 bp, Artificial
  TaSBEIIa allele with mutations introduced by TALEN pair TaSBEIIa_T03
gagagatagctggattaggcgatcgcgcttcctgaacctgtattttttccccgcgggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggccggcgcaacctgaagaattacaggtacacacactcgtgccggtaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 11623 - DNA, 490 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttacgtccgttggccccgtgctggctcttgggccactgaa

SEQ ID NO: 11624 - DNA, 471 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgggaaggtcctggtgcctgacggcgagagcgacgacttggcaagtccggcgcaacctgaaagaattacaggtacacacactcgtgccgggaaatctcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 11625 - DNA, 471 bp, Artificial; identical to SEQ ID NO: 9676
  TaSBEIIa allele with mutations introduced by TALEN pair TaSBEIIa_T03

SEQ ID NO: 11626 - DNA, 437 bp, Artificial
  TaSBEIIa allele with mutations introduced by TALEN pair TaSBEIIa_T03
gagagatagctggattaggcgatcgcctgcgtcagtgtcaccccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaggggcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggcttcttgggccactgaa

SEQ ID NO: 11627 - DNA, 379 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttggggccactgaa

SEQ ID NO: 11628 - DNA, 436 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcgttgggccactgaa

SEQ ID NO: 11629 - DNA, 429 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcgtcctggtgcctgacggtgagagcgacgacttggcaagtccggcgcaacctgaagaattacaggtacacaccatcgtgccgggaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 11630 - DNA, 331 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 11631 - DNA, 338 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcacttctttcttctgttcttgctgtaactgcaagttgtagcattgtctcactattgtagtcatccttgcaccatcgtgccgggaaatcttcatacaatcgttattcacttaccaaatgccggatgaaaccaagccgcggaggcgtcaggttttgagtcttcttctatcagcattgtgcagtactgcactgccttgtgctattttgtagccgtggccccgtgctggctcgttgggccactgaa

SEQ ID NO: 11632 - DNA, 440 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 11633 - DNA, 196 bp, Artificial; identical to SEQ ID NO: 9801
  TaSBEIIa allele with mutations introduced by TALEN pair TaSBEIIa_T03

SEQ ID NO: 11634 - DNA, 464 bp, Artificial; identical to SEQ ID NO: 11269
  TaSBEIIa allele with mutations introduced by TALEN pair TaSBEIIa_T03

SEQ ID NO: 11635 - DNA, 487 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggtcctggtgcctgacggcgagagcgacgacttggcaagtccggcgcaacctgaagaattacaggtacacacactcgtgccggtaaatcttcatacaatcgttattcacttaccaaatgccggatgaaaaccaaccacggatgcgtcaggtttcgagcttcttctatcagcattgtgcagtactgcactgccttgttcattttgttagccttggccccgtgctggctcttgggccactgaa

SEQ ID NO: 11636 - DNA, 454 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggccacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagccttggccccgtgctggctcttgggccactgaa

SEQ ID NO: 11637 - DNA, 483 bp, Artificial
  TaSBEIIa allele with mutations introduced by TALEN pair TaSBEIIa_T03
gagagatagctggattaggcgatcgcgcttcctgaacctgttatttttttcccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatcctttgcattttgcaggcgccgtcctgagccgcgcggcctctccaggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgtagcctttggccccgtgctggctcttgggccactgaa

SEQ ID NO: 11638 - DNA, 449 bp, Artificial; identical to SEQ ID NO: 10033
  TaSBEIIa allele with mutations introduced by TALEN pair TaSBEIIa_T03

SEQ ID NO: 11639 - DNA, 438 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccagggtcctggtgcctgacggtgagagcgacgacttggcaagtccggcgcaacctgaagaattacaggtacacaccatcgtgccgggaaatcttcatacaatcgttattcacttaccaaatgccggatgaaaccagccgcggaggcgtcaggtttgagcttcttctatcagcattgtgcagtactgcactgccttgtgcattttgtagccgtggccccgtgctggctcttgggccatgaa

SEQ ID NO: 11640 - DNA, 468 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcatttttttggcaaataagttgtagcattgtctcagtattgtactcatccttgcatttgcaggcgccgtcctgagccgcgcggcctctccagggtgcctgacggtgagagcgacgacttggcggccactccagcgcaacccgaagaattacaggtacacaccgtcgtgccggaaaatcttcatgcacccgttatcacttaccaaatatcggatgaaccaagccgcggaggcatcaggtttcaagcttcttctatcagcattgtgcactacttcactgccttgtgctagtttgttagctggtcggccccgcgctggcttcgttgggccactgaa

SEQ ID NO: 11641 - DNA, 413 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcgagcgacgacttggcaagtccggcgcaacctgaagaattacaggtacacaccatcgtgccgggaaatcttcatacaatcgttattcacttaccaaatgccggatgaaaccaaggccgcggaggcgtcaggttttgagcttcttctatcagcattgtgcagtactgcactgccttgtgctattttgttagccgtggccccgtgctggctcgttgggccactgaa

SEQ ID NO: 11642 - DNA, 485 bp, Artificial; identical to SEQ ID NO: 8782
  TaSBEIIa allele with mutations introduced by TALEN pair TaSBEIIa_T03

SEQ ID NO: 11643 - DNA, 415 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgttagccgtggccccgtgctggctcttgggccactgaa

SEQ ID NO: 11644 - DNA, 442 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgttggccccgtgctggctcttgggccactgaa

SEQ ID NO: 11645 - DNA, 426 bp, Artificial; identical to SEQ ID NO: 11051
  TaSBEIIa allele with mutations introduced by TALEN pair TaSBEIIa_T03

SEQ ID NO: 11646 - DNA, 433 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 11647 - DNA, 483 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcctggtgcctgacggcgagagcgacgacttggcaagtccggcgcaacctgaagaattacaggtacacaccatcgtgccgggaaatcttcatacaatcgttattcacttaccaaatgccggatgaaaaccaagccgcggaggcgtcaggttttgagcttcttctatcagcattgtgcagtactgcactgccttgtgcattttgttagccgtggccccgtgctgggctcttggggccactgaa

SEQ ID NO: 11648 - DNA, 372 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgtagccgtggccccgtgctggctcttgggccactgaa

SEQ ID NO: 11649 - DNA, 376 bp, Artificial
  TaSBEIIa allele with mutations introduced by TALEN pair TaSBEIIa_T03
gagagatagctggattaggcgatcgcctcaggccctggtgttaccacggctttgatcattcctcgtttcattctgatatatattttctcactctttttcttcctgttcttgctgtaactgcaagttgtggcgttttttcactattgtagtcagtccttgcattttgcaggcaagtccggcgcaacctgaagaattacaggtacacacactcgtgccggtaaatcttcatacaatcgttattcacttaccaaatgccggatgaaaaccaaccacggatgcgtcaggtttcgagcttcttctatcagcattgtgcagtactgcactgccttgttcatttgttagccttggccccgtgcttggctcttgggccactgaa

SEQ ID NO: 11650 - DNA, 374 bp, Artificial
  TaSBEIIa allele with mutations introduced by TALEN pair TaSBEIIa_T03
  misc_feature (330): n is a or c or t or g
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgngcattttgtagccgtggccccgtgctggctcttgggccactgaa

SEQ ID NO: 11651 - DNA, 292 bp, Artificial; identical to SEQ ID NO: 10714
  TaSBEIIa allele with mutations introduced by TALEN pair TaSBEIIa_T03

SEQ ID NO: 11652 - DNA, 479 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggcccaggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggcactgaa

SEQ ID NO: 11653 - DNA, 487 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctatttttgttagcctttggcccccgtgctcggctcgttcgggcctactgaa

SEQ ID NO: 11654 - DNA, 475 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggccctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgtgcattttgttagccgtggccccgtgctggctcttgggccactgaa

SEQ ID NO: 11655 - DNA, 397 bp, Artificial; identical to SEQ ID NO: 10615
  TaSBEIIa allele with mutations introduced by TALEN pair TaSBEIIa_T03

SEQ ID NO: 11656 - DNA, 461 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggggaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttagagcttcttctatcagcattgtgcagtactgcactgccttgttcattttgttagccttggccccgtgctggctcttgggccactgaa

SEQ ID NO: 11657 - DNA, 442 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgacgacttggcaagtccggcgcaacctgaagaattacaggtacacacactcgtgccggtaaatcttcatacaatcgttattcacttaccaaatgccggatgaaaccaagccgcggaggcgtcaggttttgagcttcttctatcagcattgtgcagtactgcactgccttgtgctattttgtagccgtggccccgtgctggctcttgggccactgaa

SEQ ID NO: 11658 - DNA, 432 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgttagccgtggccccgtgctggctcgttgggccactgaa

SEQ ID NO: 11659 - DNA, 436 bp, Artificial
  TaSBEIIa allele with mutations introduced by TALEN pair TaSBEIIa_T03
gagagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtagtcatccttgcattgcaggcgccgtcctgagcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 11660 - DNA, 464 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgtgcctgacggcgagagcgacgacttggcaagtccggcgcaacctgaagaattacaggtacacacactcgtgccggtaaaatcttcatacaatcgttattcacttaccaaatgccggatgaaaccaagccgcggaggcgtcaggttttgagcttcttctatcagcattgtgcagtactgcactgccttgtgcattttgtacgccgtggccccgtgctggctctgggccactga

SEQ ID NO: 11661 - DNA, 404 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgttagccgtggccccgtgctggctcttgggccactgaa

SEQ ID NO: 11662 - DNA, 439 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcagcaagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagctttcttctatcagcattgtgcagtactgcactgccttgttcattttgttagccttggccccgtgctggctcttgggccactgaa

SEQ ID NO: 11663 - DNA, 406 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcgtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgttggccccgtgctgggctcgttgggccactgaa

SEQ ID NO: 11664 - DNA, 442 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccacgtgaa

SEQ ID NO: 11665 - DNA, 463 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 11666 - DNA, 442 bp, Artificial; identical to SEQ ID NO: 10017
  TaSBEIIa allele with mutations introduced by TALEN pair TaSBEIIa_T03

SEQ ID NO: 11667 - DNA, 444 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctgggaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgacggaggcgtcaggttttgagcttcttctatcagcattgtgcagtactgcactgccttgtgcattttgtagccgtggccccgtggcctgggctcttgggccactgaa

SEQ ID NO: 11668 - DNA, 485 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgtagccttggccccgtgctggctcttgggccactgaa

SEQ ID NO: 11669 - DNA, 463 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagctggtgcctgacggcgagagcgacgacttggcaagtccggcgcaacctgaagaattacaggtacacacactcgtgccggtaaatcttcatacaatcgttattcacttaccaaatgccggatgaaaccaacacggatgcgtcaggtttcgagcttcttctatcagcattgtgcagtactgcactgccttgttcattttgtagccttggccccgtgctggctcttgggccactgaa

SEQ ID NO: 11670 - DNA, 459 bp, Artificial; identical to SEQ ID NO: 11190
  TaSBEIIa allele with mutations introduced by TALEN pair TaSBEIIa_T03

SEQ ID NO: 11671 - DNA, 467 bp, Artificial; identical to SEQ ID NO: 9077
  TaSBEIIa allele with mutations introduced by TALEN pair TaSBEIIa_T03

SEQ ID NO: 11672 - DNA, 387 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctctgggccactgaa

SEQ ID NO: 11673 - DNA, 482 bp, Artificial; identical to SEQ ID NO: 11382
  TaSBEIIa allele with mutations introduced by TALEN pair TaSBEIIa_T03

SEQ ID NO: 11674 - DNA, 399 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattttgcaggcggagcgacgacttggcaagtccggcgcaacctgaagaattacaggtacacacactcgtgccggtaaatcttcatacaatcgttaattcacttaccaaatgccggatgaaaccaaccacggatgcgtcaggtttcgagcttcttctatcagcattgtgcagtactgcactgccttgttcattttgttagcctttggccccgttgctgggctcttgggccactgaa

SEQ ID NO: 11675 - DNA, 432 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgttagccgtggccccgtgctggctcttgggccactgaa

SEQ ID NO: 11676 - DNA, 457 bp, Artificial
  TaSBEIIa allele with mutations introduced by TALEN pair TaSBEIIa_T03
gagagatagctggattaggcgatcgcctcaggccctggtgttaccacggctttgatcatctcctcctttcatgctgatattttctcactctttcttctgttcttgctgtaactgcaagttgtagctatttttttggcaaataagttgtagcattgtctcagtattgtactcatccttgcattttgcaggcgccgtcctgagccgcgcggcctctccagggtcctggtgcctgacggcgagagcgacgacttggcaagtccggcgcaacctgaagaattacaggtacacacactcgtgccggtaaatcttcatacaatcgttattcacttaccaatgccggatgaaaccaccacggatgcgtcaggtttcgagcttcttctatcagcattgtgcagtactgcactgccttgttcattttgttagccttggcccccgcgctggctcttgggccactgaa

SEQ ID NO: 11677 - DNA, 469 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctgacggcgagagcgacgacttggcaagtccggcgcaacctgaagaattacaggtacacacactcgtgccggtaaatcttcatacaatcgttattcacttaccaaatgccggatgaaaaccaaccacggatgcgtcaggtttcgagtcttcttctatcagcattgtgcagtactgcactgccttgttcattttgttagccttggccccgtgctggctcttgggccactgaa

SEQ ID NO: 11678 - DNA, 474 bp, Artificial; identical to SEQ ID NO: 9074
  TaSBEIIa allele with mutations introduced by TALEN pair TaSBEIIa_T03

SEQ ID NO: 11679 - DNA, 437 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccagggcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcgaggttttgagtcttcttctatcagcattgtgcagtactgcactgccttgtgcattttgtagccgtggccccgtgctggctcgttgggccacgtgaa

SEQ ID NO: 11680 - DNA, 478 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcccctggtcgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgcctggctcttgggccactgaa

SEQ ID NO: 11681 - DNA, 432 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcgggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccacgtgaa

SEQ ID NO: 11682 - DNA, 477 bp, Artificial
  TaSBEIIa allele with mutations introduced by TALEN pair TaSBEIIa_T03
gagagatagctggattaggcgatcgcgcttcctgaacctgtattttttccccgtttcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagtccttggccccgtgctggctcgtgggccactgaa

SEQ ID NO: 11683 - DNA, 475 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctcctggtgcctgacggcgagagcgacgacttggcaagtccggcgcaacctgaagaattacaggtacacacactcgtgccggtaaatcttcatacaatcgttattcacttaccaatgccggatgaaaccaccacggatgcgtcaggtttcgagcttcttctatcagcattgtgcagtactgcactgccttgttcattttgtagccttggccccgtgcctggctcttgggccactgaa

SEQ ID NO: 11684 - DNA, 474 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgttaggtttcgagcttcttctatcagcattgtgcagtactgcactgccttgttcattttgttagccttggccccgtgctggctcttgggccactgaa

SEQ ID NO: 11685 - DNA, 404 bp, Artificial; identical to SEQ ID NO: 10492
  TaSBEIIa allele with mutations introduced by TALEN pair TaSBEIIa_T03

SEQ ID NO: 11686 - DNA, 429 bp, Artificial; identical to SEQ ID NO: 10961
  TaSBEIIa allele with mutations introduced by TALEN pair TaSBEIIa_T03

SEQ ID NO: 11687 - DNA, 408 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcgtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgcctttgtgcattttgttagccgtggccccgtgcctgggctcttggggccacgtgaa

SEQ ID NO: 11688 - DNA, 408 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcgttgggccactgaa

SEQ ID NO: 11689 - DNA, 337 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgtgccgggaaatcttcatacaatcgttattcacttaccaaatgccggatgaaaccaagccgcggaggcgtcaggtttgagcttcttctatcagcattgtgcagtactgcactgccttgtgcattttgttagccgtggccccgtgctggctcttgggccactgaa

SEQ ID NO: 11690 - DNA, 433 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcgtcctggtgcctgacggtgagagcgacgacttggcaagtccggcgcaacctgaagaattacaggtacacaccatcgtgccgggaaatcttcatacaatcgttattcacttaccaaatgccggatagaaaccaagccgcggaggcgtcaggttttgagcttcttctatcagcattgtgcagtactgcactgccttgtgctattttgtagccgtggccccgttgctggcttcgttgggccatgaa

SEQ ID NO: 11691 - DNA, 380 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcaagtccggcgcaacctgaagaattacaggtacacaccatcgtgccgggaaatcttcatacaatcgttattcacttaccaaatgccggatgaaaccaagccgcggaggcgtcaggttttgagtcttcttctatcagcattgtgcagtactgcactgccttgtgctattttgtagccgtggccccgtgctggctcgttgggccactgaa

SEQ ID NO: 11692 - DNA, 475 bp, Artificial; identical to SEQ ID NO: 11379
  TaSBEIIa allele with mutations introduced by TALEN pair TaSBEIIa_T03

SEQ ID NO: 11693 - DNA, 486 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagtccttggccccgtgctggctcttgggccactgaa

SEQ ID NO: 11694 - DNA, 449 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgcttcattctgatatatattttctcactctttttcttcctgttcttgctgtaactgcaagttgtggcgttttttcactattgtagtcatccttgcattttgcaggcgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 11695 - DNA, 271 bp, Artificial
  TaSBEIIa allele with mutations introduced by TALEN pair TaSBEIIa_T03
gagagatagctggattaggcgatcgcctcaggccctggtgttaccacggctttgatcattcctcgtttcattctgatatatattttctcactctttttcttcctgttcttgctgtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 11696 - DNA, 430 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcaagtccggcgcaacctgaagaattacaggtacacacactcgtgccggtaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttggggccactgaa

SEQ ID NO: 11697 - DNA, 461 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggcccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 11698 - DNA, 262 bp, Artificial; identical to SEQ ID NO: 9893
  TaSBEIIa allele with mutations introduced by TALEN pair TaSBEIIa_T03

SEQ ID NO: 11699 - DNA, 457 bp, Artificial; identical to SEQ ID NO: 11509
  TaSBEIIa allele with mutations introduced by TALEN pair TaSBEIIa_T03

SEQ ID NO: 11700 - DNA, 431 bp, Artificial
  TaSBEIIa allele with mutations introduced by TALEN pair TaSBEIIa_T03
  misc_feature (426): n is a or c or t or g
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcgtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgttagccgtggccccgtgctggctcttgggccnctgaa

SEQ ID NO: 11701 - DNA, 395 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 11702 - DNA, 479 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggggaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggcactgaa

SEQ ID NO: 11703 - DNA, 465 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgtagccttggccccgtgctggctcttgggccactgaa

SEQ ID NO: 11704 - DNA, 389 bp, Artificial; identical to SEQ ID NO: 9958
  TaSBEIIa allele with mutations introduced by TALEN pair TaSBEIIa_T03

SEQ ID NO: 11705 - DNA, 380 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 11706 - DNA, 434 bp, Artificial
  TaSBEIIa allele with mutations introduced by TALEN pair TaSBEIIa_T03
gagagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctgacggtgagagcgacgacttggcaagtccggcgcaacctgaagaattacaggtacacacactcgtgccggtaaatcttcatacaatcgttatcacttaccaaatgccggatgaaaccacacggatgcgtcaggtttcgagcttcttctatcagcattgtgcagtactgcactgccttgttcattttgttagccttggccccgtgctggctcttgggccactgaa

SEQ ID NO: 11707 - DNA, 423 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgcctggctcttgggccactgaa

SEQ ID NO: 11708 - DNA, 449 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctacttggcaagtccggcgcaacctgaagaattacaggtacacacactcgtgccggtaaatcttcatacaatcgttattcacttaccaaatgccggatgaaaccaacacggatgcgtcaggtttcgagcttcttctatcagcattgtgcagtactgcactgccttgttcattttgtagccttggccccgtgctggctcttgggccactgaa

SEQ ID NO: 11709 - DNA, 435 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggcccccgtgctgggctcttgggccactgaa

SEQ ID NO: 11710 - DNA, 330 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcgactattgtagtcatccttgcattgcagggaaatcttcatacaatcgttattcacttaccaaatgccggatgaaaccaagccgcggaggcgtcaggtttgagcttacttctatcagcattgtgcagtactgcactgccttgtgcattttgttagccgtggccccgtgctggctcttggccactgaa

SEQ ID NO: 11711 - DNA, 432 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctcggtgcctgacggtgagagcgacgacttggcaagtccggcgcaacctgaagaattacaggtacacaccatacgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 11712 - DNA, 482 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttcgcattttgcaggcgccgtcctgagccgcgcggcctctcctggtgcctgacggcgagagcgacgacttggcaagtccggcgcaacctgaagaattacaggtacacacactcgtgccggtaaatcttcatacaatcgttaattcacttaccaaatgccggatgaaaaccaaccacggatgcgtcaggtttcgagcttcttctatcagcattgtgcagtactgcactgccttgttcattttgttagccttggccccgtgctggctcttgggccactgaa

SEQ ID NO: 11713 - DNA, 429 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcgtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactaa

SEQ ID NO: 11714 - DNA, 442 bp, Artificial
  TaSBEIIa allele with mutations introduced by TALEN pair TaSBEIIa_T03
gagagatagctggattaggcgatcgcgcttcctgaacctgttattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgcctggctcttgggccactgaa

SEQ ID NO: 11715 - DNA, 375 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgttggccccgtgctggctcttgggccactgaa

SEQ ID NO: 11716 - DNA, 481 bp, Artificial
  TaSBEIIa allele with mutations introduced by TALEN pair TaSBEIIa_T03
gagagatagctggattaggcgatcgcacttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcctggtgcctgacggcgagagcgacgacttggcaagtccggcgcaacctgaagaattacaggtacacacactcgtgccggtaaaatcttcatacaatcgttattcacttaccaaatgccggatgaaaaccaaccacggatgcgtcaggtttcgagcttcttctatcagcattgtgcagtactgcactgccttgttcattttgttagccttggccccgtgctggctcttgggccactgaa

SEQ ID NO: 11717 - DNA, 477 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcgaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 11718 - DNA, 429 bp, Artificial; identical to SEQ ID NO: 9932
  TaSBEIIa allele with mutations introduced by TALEN pair TaSBEIIa_T03

SEQ ID NO: 11719 - DNA, 477 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggcccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 11720 - DNA, 399 bp, Artificial
  TaSBEIIa allele with mutations introduced by TALEN pair TaSBEIIa_T03
gagagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggtggcggccactccagcgcaacccgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 11721 - DNA, 433 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgacgacttggcaagtccggcgcaacctgaagaattacaggtacacacactcgtgccggtaaatcttcatacaatcgttattcacttaccaaatgccggatgaaaccaaccacggatgcgtcaggttttgagcttcttctatcagcattgtgcagtactgcactgccttgtgcattttgttagccgtggccccgtgctggctcttgggccactgaa

SEQ ID NO: 11722 - DNA, 202 bp, Artificial; identical to SEQ ID NO: 9791
  TaSBEIIa allele with mutations introduced by TALEN pair TaSBEIIa_T03

SEQ ID NO: 11723 - DNA, 411 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggcccccgtgctggctcttgggccacgtgaa

SEQ ID NO: 11724 - DNA, 480 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctcgtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 11725 - DNA, 437 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcgggtcctggtgcctgacggtgagagcgacgacgttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgttagccgtggccccgtgctggctcgttgggcctacgtgaa

SEQ ID NO: 11726 - DNA, 435 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcgaggtcctggtgcctgacggtgagagcgacgacttggcaagtccggcgcaacctgaagaattacaggtacacaccatcgtgccgggaaaatcttcatacaatcgttattcacttaccaaatgccggatgaaaccaagccgcggaggcgtcaggttttgagcttcttctattcagcattgtgcagtactgcactgccttgttcattttgttagccttggccccgtgcctggctcttgggccatgaa

SEQ ID NO: 11727 - DNA, 471 bp, Artificial; identical to SEQ ID NO: 9676
  TaSBEIIa allele with mutations introduced by TALEN pair TaSBEIIa_T03

SEQ ID NO: 11728 - DNA, 459 bp, Artificial; identical to SEQ ID NO: 10947
  TaSBEIIa allele with mutations introduced by TALEN pair TaSBEIIa_T03

SEQ ID NO: 11729 - DNA, 457 bp, Artificial
  TaSBEIIa allele with mutations introduced by TALEN pair TaSBEIIa_T03
gagagatagctggattaggcgatcgcgcttcctgaacctgtattttttcccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccctggtgcctgacggcgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgtagccgtggccccgtgctggctcttgggccactgaa

SEQ ID NO: 11730 - DNA, 487 bp, Artificial
  TaSBEIIa allele with mutations introduced by TALEN pair TaSBEIIa_T03
  misc_feature (466); (467): n is a or c or t or g
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggtcctggtgcctgacggcgagagcgacgacttggcaagtccggcgcaacctgaagaattacaggtacacacactcgtgccggtaaatcttcatacaatcgttattcacttaccaaatgtccggatgaaaccaaccacggatgcgtcaggtttcgagcttcttctatcagcattgtgcagtactgcactgccttgttcattttgtagccttggccccgtnntggctcttagggccactgaa

SEQ ID NO: 11731 - DNA, 482 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatcctttgcattttgcaggcgccgtcctgagccgcgcgggaaggtcctggtgcctgacggcgagagcgacgacttggcaagtccggcgcaacctgaagaattacaggtacacacactcgtgccggtaaatcttcatacaatcgttattcacttaccaaatgccggatgaaaaccaaccacggatgcgtcaggtttcgagcttcttctatcagcattgtgcagtactgcactgccttgttcattttgttagccttggccccgtgctggctcttgggccactgaa

SEQ ID NO: 11732 - DNA, 485 bp, Artificial
  TaSBEIIa allele with mutations introduced by TALEN pair TaSBEIIa_T03
gagagtagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 11733 - DNA, 412 bp, Artificial; identical to SEQ ID NO: 10080
  TaSBEIIa allele with mutations introduced by TALEN pair TaSBEIIa_T03

SEQ ID NO: 11734 - DNA, 468 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgcctttgttcattttgttagccttggccccgtgctggctcttgggccactgaa

SEQ ID NO: 11735 - DNA, 428 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattttgcaggcgccgtcctgagccgcgcctggtgcctgacggcgagagcgacgacttggcaagtccggcgcaacctgaagaattacaggtacacacactcgtgccggtaaatcttcatacaatcgttattcacttaccaaatgccggatgaaaccaacacggatgcgtcaggtttcgagcttcttctatcagcattgtgcagtactgcactgccttgttcattttgttagccttggccccgttgctggctcttgggccactgaa

SEQ ID NO: 11736 - DNA, 363 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatcaagtccggcgcaacctgaagaattacaggtacacaccatcgtgccgggaaatcttcatacaatcgttattcacttaccaaatgccggatgaaaccaagccgcggaggcgtcaggtttgagcttcttctatcagcattgtgcagtactgcactgccttgtgctatttgttagccgtggccccgtgctggctcttgggccactgaa

SEQ ID NO: 11737 - DNA, 474 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcgtgcctgacggcgagagcgacgacttggcaagtccggcgcaacctgaagaattacaggtacacacactcgtgccggtaaatcttcatacaatcgttattcacttaccaaatgaccggatcgaaaccaaccacggatgcgtcaggtttcgagcttcttctatcagcattgtgcagtactgcactgccttgttctattttgttagtccttggccccgttgctggctcgttgggccactgaa

SEQ ID NO: 11738 - DNA, 409 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 11739 - DNA, 480 bp, Artificial; identical to SEQ ID NO: 10186
  TaSBEIIa allele with mutations introduced by TALEN pair TaSBEIIa_T03

SEQ ID NO: 11740 - DNA, 455 bp, Artificial
  TaSBEIIa allele with mutations introduced by TALEN pair TaSBEIIa_T03
gagagatagctggattaggcgatcgcgcttcctgaacctgtattttttccccgcgggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtctgacggcgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgttagccgtggccccgtgctggctcttgggccactgaa

SEQ ID NO: 11741 - DNA, 450 bp, Artificial; identical to SEQ ID NO: 11542
  TaSBEIIa allele with mutations introduced by TALEN pair TaSBEIIa_T03

SEQ ID NO: 11742 - DNA, 474 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgggaaggtcctggtgcctgacggcgagagcgacgacttggcaagtccggcgcaacctgaagattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 11743 - DNA, 484 bp, Artificial
  TaSBEIIa allele with mutations introduced by TALEN pair TaSBEIIa_T03
gagagatagctggattaggcgatcgcgcttcctgaacctgtattttttccccgcgggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcggtcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccacgtgaa

SEQ ID NO: 11744 - DNA, 423 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcaacccaggccctggtgttaccacggctttgatcattcctcgtttcattctgatatatattttctcactctttttcttcctgttcttgctgtaactgcaagttgtggcgttttttcactattgtagtcatccttgcattttgcaggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttgttagccgtggccccgtgctggctcttgggccactgaa

SEQ ID NO: 11745 - DNA, 463 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctggtgcctgacggcgagagcgacgacttggcaagtccggcgcaacctgaagaattacaggtacacacactcgtgccggtaaatcttcatacaatcgttattcacttaccaaatgccggatgaaacccaaccacggatgcgtcaggttttcgagcttcttctatcagcattgtgcagtactgcactgccttgttctattttgttagccttggccccgtgctggctcttgggccactgaa

SEQ ID NO: 11746 - DNA, 486 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgtagccttggccccgttgctggctcttgggccactgaa

SEQ ID NO: 11747 - DNA, 458 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagcctttggccccgtgctggctcttgggccactgaa

SEQ ID NO: 11748 - DNA, 461 bp, Artificial
  TaSBEIIa allele with mutations introduced by TALEN pair TaSBEIIa_T03
gagagatagctggattaggcgatcgcgcttcctgaacctgttattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgcggtcctggtgcctgacggcgagagcgacgacttggcaagtccggcgcaacctgaagaattacaggtacacacactcgtgccggtaaaatcttcatacaaatcgttattcacttaccaaatgccggatgaaaccaaccacggatgcgtcaggtttcgagcttcttctatcagcattgtgcagtactgcactgccttgtcattttgtagccttggccccgtgctggctcttgggccactgaa

SEQ ID NO: 11749 - DNA, 324 bp, Artificial; identical to SEQ ID NO: 10648
  TaSBEIIa allele with mutations introduced by TALEN pair TaSBEIIa_T03

SEQ ID NO: 11750 - DNA, 445 bp, Artificial; identical to SEQ ID NO: 10503
  TaSBEIIa allele with mutations introduced by TALEN pair TaSBEIIa_T03

SEQ ID NO: 11751 - DNA, 479 bp, Artificial; identical to SEQ ID NO: 10872
  TaSBEIIa allele with mutations introduced by TALEN pair TaSBEIIa_T03

SEQ ID NO: 11752 - DNA, 435 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaggggcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagtcttcttctatcagcattgtgcagtactgcactgccttgtgcattttgtagccgtggccccgtgctggctcttgggccactgaa

SEQ ID NO: 11753 - DNA, 455 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggccctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 11754 - DNA, 481 bp, Artificial
  TaSBEIIa allele with mutations introduced by TALEN pair TaSBEIIa_T03
gagagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgccgtcaggtttcgagcttcttctatcagcattgtgcagtactgcactgccttgttcattttgttagtccttggtccccgtgctggctcgtgggccactgaa

SEQ ID NO: 11755 - DNA, 477 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgaaggtcctggtgcctgacggcgagagcgacgacttggcaagtccggcgcaacctgaagaattacaggtacacacactcgtgccggtaaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 11756 - DNA, 338 bp, Artificial; identical to SEQ ID NO: 10597
  TaSBEIIa allele with mutations introduced by TALEN pair TaSBEIIa_T03

SEQ ID NO: 11757 - DNA, 402 bp, Artificial
  TaSBEIIa allele with mutations introduced by TALEN pair TaSBEIIa_T03
gagagatagctggattaggcgatcgcctgcgtcagtgtcacccaggccctggtgttaccacggctttgatcattcctcgtttcattctgatatatattttctcactctttttcttcctgttcttgctgtaactgcaagttgtggcgttttttcactattgtagtcatccttgcattttggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 11758 - DNA, 435 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccagggggcctgacggtgagagcgacgacttggcaagtccggcgcaacctgaagaattacaggtacacaccatcgtgccgggaaatctcatacaatcgttattcacttaccaaatgccggatgaaaccaagccgcggaggcgtcaggttttgagcttcttctatcagcattgtgcagtactgcactgccttgtgctattttgtagccgtggccccgtgctggctcttgggccactgaa

SEQ ID NO: 11759 - DNA, 476 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctggtgcctgacggcgagagcgacgacttggcaagtccggcgcaacctgaaagaattacaggtacacacactcgtgccggtaaaatcttcatacaatcgttattcacttaccaaatgccggatgaaaaccaccacggatgcgtcaggtttcgagcttcttctatcagcattgtgcagtactgcactgccttgttcattttgttagccttggccccgtgctggctcttgggccactgaa

SEQ ID NO: 11760 - DNA, 418 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgctaagttgtagcattgtctcactattgtagtcatccttgcattgcaggcgccgtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctattcagcattgtgcagtactgcactgccttgtgcattttgtagccgtggccccgtgctggctcgttgggccactgaa

SEQ ID NO: 11761 - DNA, 483 bp, Artificial
  TaSBEIIa allele with mutations introduced by TALEN pair TaSBEIIa_T03
gagagatagctggattaggcgatcgcgcttcctgaacctgttattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggaaggtcctggtgccctgacggcgagagcgacgacttggcaagtccggcgcaacctgaagaattacaggtacacacactcgtgccggtaaatcttcatacaatcgttaattcacttaccaaatgccggatgaaaaccaaccacggatgcgtcaggtttcgagcttcttctatcagcattgtgcagtactgcactgccttgttcattttgttagccttggccccgtgctggctcttgggccactgaa

SEQ ID NO: 11762 - DNA, 433 bp, Artificial
  TaSBEIIa allele with mutations introduced by TALEN pair TaSBEIIa_T03
  misc_feature (412); (428): n is a or c or t or g
gagagatagctgtattaggcgatcgcctgcgtcagtgtcacccaggccctggtgttatcacggctttgatcatctcctcccattctgatattttctcactctttcttctgttcttgctgtaactgcaagttgtagcattgtctcagtattgtactcatccttgcatttgcaggcgccgtcctgagccggaaggtcctggtgcctgacggtgagagcgacgacttggcggccactccagcgcaacccgaagaattacaggtacacaccgtcgtgccggaaaatcttcatgcacccgttattcacttaccaatatcggatgaaccaagccgcggaggcatcaggtttcaagcttcttctatcagcattgtgcactacttcactgccttgtgcagtttgttagctgtggccccgngctggctcttgggccnctgaa

SEQ ID NO: 11763 - DNA, 477 bp, Artificial; identical to SEQ ID NO: 10171
  TaSBEIIa allele with mutations introduced by TALEN pair TaSBEIIa_T03

SEQ ID NO: 11764 - DNA, 445 bp, Artificial
  TaSBEIIa allele with mutations introduced by TALEN pair TaSBEIIa_T03
gagagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggccctggtgcctgacggcgagagcgacgacttggcaagtccggcgcaacctgaagaattacaggtacacacactcgtgccggtaaatcttcatacaatcgttattcacttaccaaatgtcggatgaaaccaaccacggatgcgtcaggtttcgagcttcttctatcagcattgtgcagtactgcactgccttgttcattttgttagccttggccccgtgctggctcttgggccactgaa

SEQ ID NO: 11765 - DNA, 474 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgtcattttgttagccttggccccgtgctggctcttgggccactgaa

SEQ ID NO: 11766 - DNA, 476 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagccttggccccgtgctggctcttgggcctactgaa

SEQ ID NO: 11767 - DNA, 471 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctctgggccactgaa

SEQ ID NO: 11768 - DNA, 436 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccacgtgaa

SEQ ID NO: 11769 - DNA, 432 bp, Artificial
  TaSBEIIa allele with mutations introduced by TALEN pair TaSBEIIa_T03
  misc_feature (413): n is a or c or t or g
gagagatagctgtattaggcgatcgcctgcgtcagtgtcacccaggccctggtgttatcacggctttgatcatctcctcccattctgatattttctcactctttcttctgttcttgctgtaactgcaagttgtagcattgtctcagtattgtactcatccttgcatttgcaggcgccgtcctgagccggaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgngctggctctgggccatgaa

SEQ ID NO: 11770 - DNA, 452 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcaagcattgtgcagtactgcactgccttgttcattttgttagccttggccccgtgctggctctgggccactgaa

SEQ ID NO: 11771 - DNA, 464 bp, Artificial; identical to SEQ ID NO: 10704
  TaSBEIIa allele with mutations introduced by TALEN pair TaSBEIIa_T03

SEQ ID NO: 11772 - DNA, 371 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattttgcaggcgccgtcctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 11773 - DNA, 474 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcgttgggccactgaa

SEQ ID NO: 11774 - DNA, 467 bp, Artificial; identical to SEQ ID NO: 9077
  TaSBEIIa allele with mutations introduced by TALEN pair TaSBEIIa_T03

SEQ ID NO: 11775 - DNA, 379 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagcaacctgaagaattacaggtacacaccatcgtgccggaaatcttcatacaatcgttattcacttaccaaatgccggatgaaaccaagccgcggaggcgtcaggttttgagtcttcttctatcagcattgtgcagtactgcactgccttgtgctattttgtagccgtggccccgtgctggctcttgggccactgaa

SEQ ID NO: 11776 - DNA, 430 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgttagccgtggccccgtgctggctcttgggccatgaa

SEQ ID NO: 11777 - DNA, 479 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctctggtgcctgacggcgagagcgacgacttggcaagtccggcgcaacctgaagaattacaggtacacacactcgtgccggtaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 11778 - DNA, 475 bp, Artificial; identical to SEQ ID NO: 10305
  TaSBEIIa allele with mutations introduced by TALEN pair TaSBEIIa_T03

SEQ ID NO: 11779 - DNA, 473 bp, Artificial; identical to SEQ ID NO: 10054
  TaSBEIIa allele with mutations introduced by TALEN pair TaSBEIIa_T03

SEQ ID NO: 11780 - DNA, 509 bp, Artificial
  TaSBEIIa allele with mutations introduced by TALEN pair TaSBEIIa_T03
  misc_feature (493): n is a or c or t or g
gagagatagctggattaggcgatcgcgcttcctgaacctgtattttttccccgcggggaaatgcgttagtgtcacccaggcccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggccttgctcacggtggcgggagagttgagaggtccaccgttacagttggacacaggccaacttctcaagattgcaaaaacgtggcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgngcagtctgcactgtcc

SEQ ID NO: 11781 - DNA, 409 bp, Artificial
  TaSBEIIa allele with mutations introduced by TALEN pair TaSBEIIa_T03
gagagatagctggattaggcgatcgcctcaggccctggtgttatcacggctttgatcatctcctcccattctgatatttttctcactctttcttctgttcttgctgtaactgcaagttgtagcattgtctcactattgtagtcatccttgcattgcaggcgccgtcctgagccgcgcggcctctccagggagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 11782 - DNA, 472 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcgcctggtgcctgacggcgagagcgacgacttggcaagtccggcgcaacctgaagattacaggtacacacactcgtgccggtaaaatcttcatacaatcgttattcacttaccaaatgccggatgaaaaccaccacggatgcgtcaggtttcgagcttcttctatcagcattgtgcagtactgcactgccttgttcattttgtagccttggccccgtgctggctcttgggccactgaa

SEQ ID NO: 11783 - DNA, 435 bp, Artificial
  TaSBEIIa allele with mutations introduced by TALEN pair TaSBEIIa_T03
gagagatagctggattaggcgatcgcctgcgtcagtgtcacccaggccttggtgttatcacggctttgatcatctcctcccattctgatattttctcactctttcttctgttcttgctgtaactgcaagttgtagcattgtctcactattgtagtcatccttgcattgcaggcgccgtcctgagccggaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcgaggttttgagtcttcttctatcagcattgtgcagtactgcactgccttgtgctattttgtagccgtggccccgtgctggctcgttgggccacgtgaa

SEQ ID NO: 11784 - DNA, 479 bp, Artificial
  TaSBEIIa allele with mutations introduced by TALEN pair TaSBEIIa_T03
gagagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctccctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 11785 - DNA, 480 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcctggtgcctgacggcgagagcgacgacttggcaagtccggcgcaacctgaagaattacaggtacacacactcgtgccggtaaatcttcatacaatcgttattcacttaccaaatgccggatgaaaaccaaccacggatggcgtcaggtttcgagcttcttctatcagcattgtgcagtactgcactgccttgttcattttgttagccttggccccgtgctggctctgggccactgaa

SEQ ID NO: 11786 - DNA, 403 bp, Artificial; identical to SEQ ID NO: 11026
  TaSBEIIa allele with mutations introduced by TALEN pair TaSBEIIa_T03

SEQ ID NO: 11787 - DNA, 482 bp, Artificial
  TaSBEIIa allele with mutations introduced by TALEN pair TaSBEIIa_T03
gagagatagctggattaggcgatcgcgcttcctgaacctgtatttttttccccgcgggggaaatgcgttagtgtcaccccaggcccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagccttggccccgtgctggctcttgggccactgaa

SEQ ID NO: 11788 - DNA, 448 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagcagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 11789 - DNA, 379 bp, Artificial
  TaSBEIIa allele with mutations introduced by TALEN pair TaSBEIIa_T03
gagagatagctggattaggcgatcgcctcaggccctggtgttaccacggctttgatcatctcctcctttcatgctgatattttctcactctttttcttcctgttcttgctgtaactgcaagttgtggcgttttttcactattgtagtcatccttgcattttgcaggcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgtagccttggccctgctggctcttgggccactgaa

SEQ ID NO: 11790 - DNA, 465 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 11791 - DNA, 469 bp, Artificial; identical to SEQ ID NO: 11166
  TaSBEIIa allele with mutations introduced by TALEN pair TaSBEIIa_T03

SEQ ID NO: 11792 - DNA, 481 bp, Artificial
  TaSBEIIa allele with mutations introduced by TALEN pair TaSBEIIa_T03
gagagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagtccttcggccccgtgctggctcttgggccactgaa

SEQ ID NO: 11793 - DNA, 462 bp, Artificial; identical to SEQ ID NO: 10789
  TaSBEIIa allele with mutations introduced by TALEN pair TaSBEIIa_T03

SEQ ID NO: 11794 - DNA, 449 bp, Artificial; identical to SEQ ID NO: 11435
  TaSBEIIa allele with mutations introduced by TALEN pair TaSBEIIa_T03

SEQ ID NO: 11795 - DNA, 449 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctggggaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagctttcgttctatcagcattgtgcagtactgcactgcccttgtgctattttgttagccgttggccccgtgcgtggctcgttgggccactgaa

SEQ ID NO: 11796 - DNA, 463 bp, Artificial
  TaSBEIIa allele with mutations introduced by TALEN pair TaSBEIIa_T03
gagagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 11797 - DNA, 448 bp, Artificial
  TaSBEIIa allele with mutations introduced by TALEN pair TaSBEIIa_T03
gagagatagctggattaggcgatcgcgcttcctgaacctgttattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 11798 - DNA, 468 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgcctggctcttgggccactgaa

SEQ ID NO: 11799 - DNA, 387 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcaagaattacaggtacacacactcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 11800 - DNA, 443 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttcggccccgtgctggctcttgggccactgaa

SEQ ID NO: 11801 - DNA, 464 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgtgcattttgttagccgtggccccgtgctggctcttgggccactgaa

SEQ ID NO: 11802 - DNA, 389 bp, Artificial; identical to SEQ ID NO: 10094
  TaSBEIIa allele with mutations introduced by TALEN pair TaSBEIIa_T03

SEQ ID NO: 11803 - DNA, 195 bp, Artificial; identical to SEQ ID NO: 9876
  TaSBEIIa allele with mutations introduced by TALEN pair TaSBEIIa_T03

SEQ ID NO: 11804 - DNA, 450 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcatctcctcccattctgatattttctcactctttcttctgttcttgctgtaactgcaagttgtagcattgtctcactattgtagtcatccttgcattgcaggcgccgctggtgcctgacggtgagagcgacgacttggcaagtccggcgcaacctgaagaattacaggtacacaccatcgtgccgggaaatcttcatacaatcgttattcactttaccaaatgccggatgaaaccaagccgcggaggcgtcaggttttgagcttcttctatcagcattgtgcagtactgcactgccttgtgctattttgttagccgtggccccgtgctggctcttgggccactgaa

SEQ ID NO: 11805 - DNA, 473 bp, Artificial
  TaSBEIIa allele with mutations introduced by TALEN pair TaSBEIIa_T03
gagagatagctggattaggctatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggtggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagtccttggccccgtgctggctcttgggccactgaa

SEQ ID NO: 11806 - DNA, 439 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 11807 - DNA, 474 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcgggtcctggtgcctgacggcgagagcgacgacttggcaagtccggcgcaacctgaagaattacaggtacacacactcgtgccggtaaatcttcatacaatcgttattcacttaccaatgccggatgaaaccaaccacggatgcgtcaggtttcgagcttcttctatcagcattgtgcagtactgcactgccttgttcattttgttagccttggccccgtgctggctctgggtcactgaa

SEQ ID NO: 11808 - DNA, 402 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtggtgagagcgacgacttggcaagtccggcgcaacctgaagaattacaggtacacaccatcgtgccgggaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctcgttgggccactgaa

SEQ ID NO: 11809 - DNA, 442 bp, Artificial
  TaSBEIIa allele with mutations introduced by TALEN pair TaSBEIIa_T03
gagagatagctggattaggcgatcgcgcttcctgaacctgtattttttccccgcgggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagccttggccccgtgctggctcttgggccactgaa

SEQ ID NO: 11810 - DNA, 437 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcgacttggcaagtccggcgcaacctgaagaattacaggtacacacactcgtgccggtaaatcttcatacaatcgttattcacttaccaaatgccggatgaaaccaaccacggatgcgtcaggttttcgagcttcttctatcagcattgtgcagtactgcactgccttgttcattttgttagccttggccccgtgctggctcttgggccactgaa

SEQ ID NO: 11811 - DNA, 450 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcgacgacttggcaagtccggcgcaacctgaagaattacaggtacacacactcgtgccggtaaatcttcatacaatcgttattcacttaccaaatgccggatgaaaccaccacggatgcgtcaggtttcagcttctctatcagcattgtgcagtactgcactgccttgttcattttgttagccttggccccgtgctggctcttgggccactgaa

SEQ ID NO: 11812 - DNA, 441 bp, Artificial
  TaSBEIIa allele with mutations introduced by TALEN pair TaSBEIIa_T03
gagagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctgacggtgagagcgacgacttggcggccactccagcgcaacccgaagaattacaggtacacacactcgtgccggtaaatcttcatacaatcgttattcacttaccaaatgccggatgaaaccaaccacggatgcgtcaggttttcgagcttcttctatcagcattgtgcagtactgcactgccttgttcattttgttagccttggccccgtgctggctcttgggccactgaa

SEQ ID NO: 11813 - DNA, 421 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 11814 - DNA, 478 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggcccccgtgctggctcgttgggccactgaa

SEQ ID NO: 11815 - DNA, 456 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaaggtttcagcttcttctatcagcattgtgcagtactgcactgccttgttcattttgttagccttggccccgtgctggctcttgggcactgaa

SEQ ID NO: 11816 - DNA, 292 bp, Artificial; identical to SEQ ID NO: 10714
  TaSBEIIa allele with mutations introduced by TALEN pair TaSBEIIa_T03

SEQ ID NO: 11817 - DNA, 455 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgagagcgacgacttggcaagtccggcgcaacctgaagaattacaggtacacacactcgtgccggtaaatcttcatacaatcgttaattcacttaccaaatgccggatgaaaccaaccacggatgcgtcaggtttcgagcttcttctatcagcattgtgcagtactgcactgccttgttcattttgttagccttggcccccgttgctggctcttgggccactgaa

SEQ ID NO: 11818 - DNA, 198 bp, Artificial
  TaSBEIIa allele with mutations introduced by TALEN pair TaSBEIIa_T03
gagagatagctggattaggcgatcgcctgcgtcagtgtcacccaggcctcatacaatcgttattcacttaccaaatgccggatgaaaccaagccgcggaggcgtcaggttttgagcttcttctatcagcattgtgcagtactgcactgccttgtgcattttgttagccgtggcccgtgctggctcttgggccactgaa

SEQ ID NO: 11819 - DNA, 483 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggttcgagcttcttctatcagcattgtgcagtactgcactgccttgttctattttgttagtccgttcggccccgtgctggctcgttgggcctactgaa

SEQ ID NO: 11820 - DNA, 405 bp, Artificial
  TaSBEIIa allele with mutations introduced by TALEN pair TaSBEIIa_T03
  misc_feature (381): n is a or c or t or g
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctggcaagtccggcgcaacctgaagaattacaggtacacaccatcgtgccgggaaatcttcatacaatcgttattcacttaccaaatgccggatgaaaccagccgcggaggcatcaggtttcaagcttcttctatcagcattgtgcactacttcactgccttgtgctagtttgtagctgtggccccgngctgggctcgttgggccacgtgaa

SEQ ID NO: 11821 - DNA, 440 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggcccctggtgttaccacggctttgatcatctcctcccattctgatattttctcactctttcttctgttcttgctgtaactgcaagttgtagcattgtctcactattgtagtcatccttgcattgcaggcgccgtcctgagccgcgcggcctggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgttagccgttggccccgtgctggctcttgggccactgaa

SEQ ID NO: 11822 - DNA, 478 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgggaaggtcctggtgcctgacggcgagagcgacgacttggcaagtccggcgcaacctgaagaattacaggtacacacactcgtgccggtaaatcttcatacaatcgttattcacttaccaaatgccggatgaaaaccaaccacggatgcgtcaggtttcgagcttcttctatcagcattgtgcagtactgcactgccttgttctattttgttagccttggccccgtgctggctcttgggccactgaa

SEQ ID NO: 11823 - DNA, 469 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagtcttcttctatcagcattgtgcagtactgcactgccttgttcattttgttagccttggccccgtgctggctcgtgggccactgaa

SEQ ID NO: 11824 - DNA, 487 bp, Artificial
  TaSBEIIa allele with mutations introduced by TALEN pair TaSBEIIa_T03
  misc_feature (465): n is a or c or t or g
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcactacttcactgccttgtgctagtttgttagctgtggccccgngctggctcgttgggccactgaa

SEQ ID NO: 11825 - DNA, 461 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctggtgcctgacggcgagagcgacgacttggcaagtccggcgcaacctgaagaattacaggtacacacactcgtgccggtaaatcttcatacaatcgttattcacttaccaaatgccggatgaaaaccaaccacggatgcgtcaggtttcgagcttcttctatcagcattgtgcagtactgcactgccttgttcattttgttagccttggccccgtgctggctcttgggccactgaa

SEQ ID NO: 11826 - DNA, 471 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttctctatcagcattgtgcagtactgcactgccttgttcattttgttagccttggccccgtgctggctcttgggccactgaa

SEQ ID NO: 11827 - DNA, 479 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagccttggccccgtgctggctcttgggccactgaa

SEQ ID NO: 11828 - DNA, 485 bp, Artificial
  TaSBEIIa allele with mutations introduced by TALEN pair TaSBEIIa_T03
  misc_feature (480): n is a or c or t or g
gagagatagctggattaggcgatcgcgcttcctgaacctgttattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaaacctgaagaattacaggtacacacactcgtgccggtaaatcttcatacaatcgttattcattaccaaatgccggatgaaaaccaaccacggatgcgtcaggtttcgagcttcttctatcagcattgtgcagtactgcactgccttgttcattttgtagccttggcccctgctggctcttgggccnctgaa

SEQ ID NO: 11829 - DNA, 473 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgccctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgcctggctcttgggccactgaa

SEQ ID NO: 11830 - DNA, 386 bp, Artificial
  TaSBEIIa allele with mutations introduced by TALEN pair TaSBEIIa_T03
gagagatagctggattaggcgatcgcctcaggccctggtgttaccacggctttgatcatctcctcctttcatgctgatattttctcactctttcttctgttcttgctgtaactgcaagttgtagcattgtctcactattgtagtcatccttggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 11831 - DNA, 441 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcagcttcttctatcagcattgtgcagtactgcactgccttgttcattttgttagccttggccccgtgctggctcttgggccactgaa

SEQ ID NO: 11832 - DNA, 480 bp, Artificial; identical to SEQ ID NO: 10186
  TaSBEIIa allele with mutations introduced by TALEN pair TaSBEIIa_T03

SEQ ID NO: 11833 - DNA, 469 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcagcttcttctatcagcattgtgcagtactgcactgccttgttcattttgttagccttggcccccgttgcctggctcttgggccactgaa

SEQ ID NO: 11834 - DNA, 356 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattacaatcgttattcacttaccaaatgccggatgaaaccaagccgcggaggcgtcaggttttgagcttcttctatcagcattgtgcagtactgcactgccttgtgcattttgtagccgtggccccgtgctggctcttgggccactgaa

SEQ ID NO: 11835 - DNA, 438 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcagcaagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 11836 - DNA, 459 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgcggtcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 11837 - DNA, 380 bp, Artificial
  TaSBEIIa allele with mutations introduced by TALEN pair TaSBEIIa_T03
gagagatagctggattaggcgatcgcctcaggccctggtgttaccacggctttgatcatctcctcctttcatgctgatattttctcactctttttcttcctgttcttgctgtaactgcaagttgtggcgttttttcactattgtagtcatccttgcattttgcaggcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgtcattttgtagccttggccccgtgctggctcttgggccactgaa

SEQ ID NO: 11838 - DNA, 457 bp, Artificial; identical to SEQ ID NO: 10620
  TaSBEIIa allele with mutations introduced by TALEN pair TaSBEIIa_T03

SEQ ID NO: 11839 - DNA, 474 bp, Artificial; identical to SEQ ID NO: 9013
  TaSBEIIa allele with mutations introduced by TALEN pair TaSBEIIa_T03

SEQ ID NO: 11840 - DNA, 485 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgtattcacttaccaaatgccggatgaaaccaccacggatgcgtcaggtttcgagcttcttctatcagcattgtgcagtactgcactgccttgtctattttgttagccttggccccgtgcctgggctcttgggccactgaa

SEQ ID NO: 11841 - DNA, 378 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgtagccgtggccccgtgctggctcttgggccactgaa

SEQ ID NO: 11842 - DNA, 429 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagtcttcttctatcagcattgtgcagtactgcactgccttgtgcattttgtagccgtggccccgtgctggctcttgggccatgaa

SEQ ID NO: 11843 - DNA, 480 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggcccaggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagccttggccccgtgctggctcttgggccactga

SEQ ID NO: 11844 - DNA, 289 bp, Artificial
  TaSBEIIa allele with mutations introduced by TALEN pair TaSBEIIa_T03
gaggatagctggattaggcgatcgcctgcgtcagtgtcacccaggcccgtggtgttatcacggctttgatcatctcctcccattctgatattttctcactctttcttctgttcttgctgtaactgcaagttgtagcattgtctcactcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 11845 - DNA, 459 bp, Artificial; identical to SEQ ID NO: 10743
  TaSBEIIa allele with mutations introduced by TALEN pair TaSBEIIa_T03

SEQ ID NO: 11846 - DNA, 464 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggggaaggtcctggtgcctgacggcgagagcgacgacttggcaagtccggcgcaacctgaagaattacaggtacacacactcgtgccgggaaatcttcatacaatcgttattcacttaccaaatgccggatgaaaccaagccgcggaggcgtcaggttttgagtcttcttctatcagcattgtgcagtactgcactgccttgtgctattttgttagccgtggccccgtgctggctcttgggccactgaa

SEQ ID NO: 11847 - DNA, 482 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggcccaggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccctggtgcctgacggcgagagcgacgacttggcaagtccggcgcaacctgaagaattacaggtaccacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagccttggccccgtgctggctcttgggccactgaa

SEQ ID NO: 11848 - DNA, 325 bp, Artificial; identical to SEQ ID NO: 10348
  TaSBEIIa allele with mutations introduced by TALEN pair TaSBEIIa_T03

SEQ ID NO: 11849 - DNA, 479 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggtcgttttttcactattgtagtcatccttgcattttgcaggcgccgtcctgagccgcgcggcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggttttgagctttcttctatcagcattgtgcagtactgcactgccttgtgctattttgttagccgtcggccccgtgctggctcgttgggccactgaa

SEQ ID NO: 11850 - DNA, 477 bp, Artificial
  TaSBEIIa allele with mutations introduced by TALEN pair TaSBEIIa_T03
gagagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgaaggtcctggtgcctgacggcgagagcgacgacttggcaagtccggcgcaacctgaagaattacaggtacacacactcgtgccggtaaatcttcatacaatcgttattcacttacaaatgccggatgaaaccaaccacggatgcgtcaggtttcgagcttcttctatcagcattgtgcagtactgcactgccttgttcattttgttagccttggccccgtgctggctcttggggccactgaa

SEQ ID NO: 11851 - DNA, 476 bp, Artificial
  TaSBEIIa allele with mutations introduced by TALEN pair TaSBEIIa_T03
  misc_feature (372): n is a or c or t or g
gagagatagctggattaggcgatcgcgcttcctgaacctgtattttttccccgcgggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccggaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccncggatgcgtcaggtttcgagcttcttctatcagcattgtgcagtactgcactgccttgttcattttgttagccttggccccgtgctggctcttgggccactgaa

SEQ ID NO: 11852 - DNA, 471 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttctctatcagcattgtgcagtactgcactgccttgttcattttgttagccttggccccgtgcctggctcttgggccactgaa

SEQ ID NO: 11853 - DNA, 475 bp, Artificial
  TaSBEIIa allele with mutations introduced by TALEN pair TaSBEIIa_T03
gagagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 11854 - DNA, 465 bp, Artificial
  TaSBEIIa allele with mutations introduced by TALEN pair TaSBEIIa_T03
gagagatagctggattaggcgatcgcgcttcctgaacctgttattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcagcttcttctatcagcattgtgcagtactgcactgccttgtgctattttgttagccgtggccccgtgctggactcgttgggccactgaa

SEQ ID NO: 11855 - DNA, 426 bp, Artificial
  TaSBEIIa allele with mutations introduced by TALEN pair TaSBEIIa_T03
ggagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccaagtccggcgcaacctgaagaattacaggtacacacactcgtgccggtaaatcttcatacaatcgttattcacttaccaaatgccggatgaaaccaaccacggatgcgtcaggttttcgagcttcttctatcagcattgtgcagtactgcactgccttgttcattttgtagccttggccccgtgctggctcttgggccactgaa

SEQ ID NO: 11856 - DNA, 458 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggttttgagcttcttctatcagcattgtgcagtactgcactgccttgtgcattttgttagccgtggccccgtgctggctcttgggccatgaa

SEQ ID NO: 11857 - DNA, 455 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgcctggctcttgggccactgaa

SEQ ID NO: 11858 - DNA, 444 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgttggcccccgtgctgggctcttgggccactgaa

SEQ ID NO: 11859 - DNA, 245 bp, Artificial; identical to SEQ ID NO: 10331
  TaSBEIIa allele with mutations introduced by TALEN pair TaSBEIIa_T03

SEQ ID NO: 11860 - DNA, 381 bp, Artificial; identical to SEQ ID NO: 10765
  TaSBEIIa allele with mutations introduced by TALEN pair TaSBEIIa_T03

SEQ ID NO: 11861 - DNA, 404 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcgtgcctgacggtgagagcgacgacttgggcaagtccggcgcaacctgaagaattacaggtacacaccatcgtgccgggaaatcttcatacaatcgttattcacttaccaaatgccggatgaaaccaagccgcggaggcatcaggtttcaagcttcttctatcagcattgtgcactacttcactgccttgtgcagtttgttagctgtggccccgcgctggctcttgggccactgaa

SEQ ID NO: 11862 - DNA, 449 bp, Artificial
  TaSBEIIa allele with mutations introduced by TALEN pair TaSBEIIa_T03
gagagatagctggtttaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgtcattttgttagccttggccccgtgctggctcttgggccactgaa

SEQ ID NO: 11863 - DNA, 470 bp, Artificial
  TaSBEIIa allele with mutations introduced by TALEN pair TaSBEIIa_T03
gagagatagctggattaggcgatcgcgcttcctgaacctgtattttttccccgcgggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcgtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagtccttggccccgtgctggctcttgggccactgaa

SEQ ID NO: 11864 - DNA, 473 bp, Artificial; identical to SEQ ID NO: 10036
  TaSBEIIa allele with mutations introduced by TALEN pair TaSBEIIa_T03

SEQ ID NO: 11865 - DNA, 479 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcgggaaggtcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagtcttggccccgtgctggctcttgggccactgaa

SEQ ID NO: 11866 - DNA, 438 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgctattttgttagccgtggccccgtgctggctcgttgggccacgtgaa

SEQ ID NO: 11867 - DNA, 468 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggtcgttttttcactattgtagtcatccttgcattttgcaggcgccgtcctgagccgggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgcctggctcttgggccactgaa

SEQ ID NO: 11868 - DNA, 479 bp, Artificial
  TaSBEIIa allele with mutations introduced by TALEN pair TaSBEIIa_T03
gagagatagctggattaggcgatcgcgcttcctgaacctgttatttttttccccgcggggaaatgcgttagtgtcacccaggccctggtgttaccacggctttgatcattcctcgtttcattctgatatatatttttctcactctttttcttcctgttcttgctgtaactgcaagttgtggcgttttttcactattgtagtcatccttgcattttgcaggcgccgtcctgagccgcgcggcctctctggtgcctgacggcgagagcgacgacttggcaagtccggcgcaacctgaagaattacaggtacacacactcgtgccggtaaatcttcatacaatcgttattcacttaccaatgccggatgaaaccaccacggatgcgtcaggtttcgagcttcttctatcagcattgtgcagtactgcactgccttgttcattttgttagccttggccccgtgctggctcttgggccactgaa

SEQ ID NO: 11869 - DNA, 471 bp, Artificial
  TaSBEIIa allele with mutations introduced by TALEN pair TaSBEIIa_T03
gagagatagctggattaggcgatcgcgcttcctgaacctgtattttttccccgcgggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 11870 - DNA, 463 bp, Artificial
  TaSBEIIa allele with mutations introduced by TALEN pair TaSBEIIa_T03
gagagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcatttttgcaggcgccgtcctggtgcctgacggcgagagcgacgacttggcaagtccggcgcaacctgaagaattacaggtacacacactcgtgccggtaaaatcttcatacaatcgttattcacttaccaaatgccggatgaaaccaaccacggatgacgtcaggtttcgagcttcttctatcagcattgtgcagtactgcactgccttgttcattttgttagccttggccccgtgctggctcttgggccactga

SEQ ID NO: 11871 - DNA, 476 bp, Artificial
  TaSBEIIa allele with mutations introduced by TALEN pair TaSBEIIa_T03
gagagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcagggtttcgagcttcttctatcagcattgtgcagtactgcactgccttgttctattttgttagccttcggccccgtgcgtggctcttgggccactgaa

SEQ ID NO: 11872 - DNA, 482 bp, Artificial
  TaSBEIIa allele with mutations introduced by TALEN pair TaSBEIIa_T03
gagagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcatttttgttagccttcggccccgtgctggctcttgggccacgtgaa

SEQ ID NO: 11873 - DNA, 462 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcatttttgcaggcgccgtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggttttcgagcttcttctatcagcattgtgcagtactgcactgccttgttcattttgttagccttggccccgtgctggctcttgggccactgaa

SEQ ID NO: 11874 - DNA, 411 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcgggcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccacgtgaa

SEQ ID NO: 11875 - DNA, 428 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcgcctggtgcctgacggtgagagcgacgacttggcaagtccggcgcaacctgaagaattacaggtacacaccatcgtgccggaaatcttcatacaatcgttattcacttaccaaatgccggatgaaaccaagccgcggaggcgtcaggttttgagcttcttctatcagcattgtgcagtactgcactgccttgttcattttgttagccttggccccgtgctggctcttgggccactgaa

SEQ ID NO: 11876 - DNA, 408 bp, Artificial; identical to SEQ ID NO: 11575
  TaSBEIIa allele with mutations introduced by TALEN pair TaSBEIIa_T03

SEQ ID NO: 11877 - DNA, 466 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 11878 - DNA, 459 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggccagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 11879 - DNA, 481 bp, Artificial
  TaSBEIIa allele with mutations introduced by TALEN pair TaSBEIIa_T03
gagagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagccttggccccgtgctggctcttgggccactgaa

SEQ ID NO: 11880 - DNA, 488 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggtcctggtgcctgacggcgagagcgacgacttggcaagtccggcgcaaacctgaagaattacaggtacacacactcgtgccggtaaatcttcatacaatcgttattcacttaccaaatgccggatgaaaaccaaccacggatgcgtcaggtttcgaggcttcttctatcagcattgtgcagtactgcactgccttgttcattttgttagccttggccccgtgctggctcttgggccactga

SEQ ID NO: 11881 - DNA, 442 bp, Artificial; identical to SEQ ID NO: 10432
  TaSBEIIa allele with mutations introduced by TALEN pair TaSBEIIa_T03

SEQ ID NO: 11882 - DNA, 469 bp, Artificial
  TaSBEIIa allele with mutations introduced by TALEN pair TaSBEIIa_T03
gagagatagctggattaggcgatcgcgcttcctgaacctgtattttttcccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcatttttgcaggcgccgtcctgagccgcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagtcttcttctatcagcattgtgcagtactgcactgccttgttcattttgtagccttggccccgtgctggctcttgggccactgaa

SEQ ID NO: 11883 - DNA, 431 bp, Artificial
  TaSBEIIa allele with mutations introduced by TALEN pair TaSBEIIa_T03
gagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctggtgcctgacggtgagagcgacgacttggcaagtccggcgcaacctgaagaattacaggtacacaccatcgtgccggaaatcttcatacaatcgttattcacttaccaaatgccggatgaaaccaagccgcggaggcgtcaggttttgagcttcttctatcagcattgtgcagtactgcactgccttgtgctattttgttagccgtggccccgtgctggctcgttgggccactgaa

SEQ ID NO: 11884 - DNA, 366 bp, Artificial
  TaSBEIIa allele with mutations introduced by TALEN pair TaSBEIIa_T03
gagagatagctggattaggcgatcgcctcaggccctggtgttaccacggctttgatcatctcctcctttcatgctgatattttctcactctttcttctgttcttgctgtaactgcaagttgtagcattgtctcactattgtagtcatccttgcattgcaggcgtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgcttggctcttgggccactgaa

SEQ ID NO: 11885 - DNA, 466 bp, Artificial
  TaSBEIIa allele with mutations introduced by TALEN pair TaSBEIIa_T03
gagagatagctggattaggcgatcgcgcttcctgaacctgttattttttcccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagagcgacgacttggcaagtccggcgcaacctgaagaattacaggtacacacactcgtgccggtaaaatcttcatacaatcgttattcacttaccaaatgccggatgaaaccaaccacggatgcgtcaggtttcagcttcttctatcagcattgtgcagtactgcactgccttgttcattttgttagccttggccccgtgctggctcttgggccactgaa

SEQ ID NO: 11886 - DNA, 470 bp, Artificial
  TaSBEIIa allele with mutations introduced by TALEN pair TaSBEIIa_T03
gagagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagccttggccccgtgctggctcgttgggccactgaa

SEQ ID NO: 11887 - DNA, 471 bp, Artificial
  TaSBEIIa allele with mutations introduced by TALEN pair TaSBEIIa_T03
gagagatagctggattaggcgatcgcgcttcctgaacctgtattttttccccgcgggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcctggtgcctgacggcgagagcgacgacttggcaagtccggcgcaacctgaagaattacaggtacacacactcgtgccggtaaatcttcatacaatcgttattcacttaccaaatgcccggatgaaaaccaccacggatgcgtcaggtttcgagcttcttctatcagcattgtgcagtactgcactgccttgttcattttgttagccttggccccgtgctggctcttgggccactgaa

SEQ ID NO: 11888 - DNA, 501 bp, Artificial
  TaSBEIIa allele with mutations introduced by TALEN pair TaSBEIIa_T03
  misc_feature (460): n is a or c or t or g
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctagagccgcgcggccttgctcacggtggcgggagagttgagaggtccaccgttacagttggacacaggccaacttctcaaagattgcaaaacgtggcctggtgacctgacggcgagagcgacgacttggcaagtccggcgcaacctgaaagaattacaggtacacacactcgtgccggtaaatcttcatacaatcgttattcacttaccaaatgccggatgaaaccaccacggangcgtcaggtttcgagcttcttctatcagcattcgtgcagta

SEQ ID NO: 11889 - DNA, 476 bp, Artificial
  TaSBEIIa allele with mutations introduced by TALEN pair TaSBEIIa_T03
gagagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttctattttgttagtccttggccccgtgctggctcttgggccactgaa

SEQ ID NO: 11890 - DNA, 98 bp, Triticum aestivum
gcgccgtcctgagccgcgcggcctctccagggaaggtcctggtgcctgacggtgagagcgacgacttggcaagtccggcgcaacctgaagaattacag

SEQ ID NO: 11891 - DNA, 242 bp, Triticum aestivum
atacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccg

SEQ ID NO: 11892 - DNA, 101 bp, Triticum aestivum
gcgccgtcctgagccgcgcggcctctccagggaaggtcctggtgcctgacggtgagagcgacgacttggcggccactccagcgcaacccgaagaattacag

SEQ ID NO: 11893 - DNA, 242 bp, Triticum aestivum
atacctgaagatatcgaggagcaaacggctgaagtgaacatgacaggggggactgcagagaaacttcaatattcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccg

SEQ ID NO: 11894 - DNA, 98 bp, Triticum aestivum
gcgccgtcctgagccgcgcggcctctccagggaaggtcctggtgcctgacggcgagagcgacgacttggcaagtccggcgcaacctgaagaattacag

SEQ ID NO: 11895 - DNA, 242 bp, Triticum aestivum
atacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactgaaagattttcggagccatcttgactaccg

SEQ ID NO: 11896 - DNA, 49 bp, Triticum aestivum; identical to SEQ ID NO: 7

SEQ ID NO: 11897 - DNA, 49 bp, Triticum aestivum
tatacgagattgacccaacactgaaagattttcggagccatcttgacta

SEQ ID NO: 11898 - DNA, 50 bp, Triticum aestivum
ttcagaaccgactcaaggcattgtggaaacaatcactgatggtgtaacca

SEQ ID NO: 11899 - DNA, 50 bp, Triticum aestivum; identical to SEQ ID NO: 6

SEQ ID NO: 11900 - DNA, 49 bp, Triticum aestivum
tcctgagccgcgcggcctctccagggaaggtcctggtgcctgacggtga

SEQ ID NO: 11901 - DNA, 49 bp, Triticum aestivum; identical to SEQ ID NO: 8

SEQ ID NO: 11902 - DNA, 17 bp, Artificial
  synthetic oligonucleotide primer
cggactgctgccgcgat

SEQ ID NO: 11903 - DNA, 25 bp, Artificial
  synthetic oligonucleotide primer
tgtagccatcaattatacatctacg

SEQ ID NO: 11904 - DNA, 17 bp, Artificial
  synthetic oligonucleotide primer
ggcggactgctgcgatc

SEQ ID NO: 11905 - DNA, 25 bp, Artificial
  synthetic oligonucleotide primer
caattgtagccagcaattatacata

SEQ ID NO: 11906 - DNA, 21 bp, Artificial
  synthetic oligonucleotide primer
ttttccccgcggggaaatgcg

SEQ ID NO: 11907 - DNA, 27 bp, Artificial
  synthetic oligonucleotide primer
tccaccttcatgttggtcaatagcagc

SEQ ID NO: 11908 - DNA, 100 bp, Triticum aestivum
gtcatccttgcattgcaggcgccgtcctgagccgcgcggcctctccagggaaggtcctggtgcctgacggtgagagcgacgacttggcaagtccggcgca

SEQ ID NO: 11909 - DNA, 102 bp, Artificial
  mutant
gtcatccttgcattgcaggcgccgtcctgagccgcgcggcctctccagggggaaggtcctggtgcctgacggtgagagcgacgacttggcaagtccggcgca

SEQ ID NO: 11910 - DNA, 77 bp, Artificial
  mutant
gtcatccttgcattgcaggcgccgtcctgagccgcgcggcctgacggtgagagcgacgacttggcaagtccggcgca

SEQ ID NO: 11911 - DNA, 104 bp, Triticum aestivum
ctcatccttgcatttgcaggcgccgtcctgagccgcgcggcctctccagggaaggtcctggtgcctgacggtgagagcgacgacttggcggccactccagcgca

SEQ ID NO: 11912 - DNA, 100 bp, Artificial
  mutant
ctcatccttgcatttgcaggcgccgtcctgagccgcgcggcctctccaaggtcctggtgcctgacggtgagagcgacgacttggcggccactccagcgca

SEQ ID NO: 11913 - DNA, 84 bp, Artificial
  mutant
ctcatccttgcatttgcaggcgccgtcctgagccgcgcggctgcctgacggtgagagcgacgacttggcggccactccagcgca

SEQ ID NO: 11914 - DNA, 102 bp, Triticum aestivum
gtcatccttgcattttgcaggcgccgtcctgagccgcgcggcctctccagggaaggtcctggtgcctgacggcgagagcgacgacttggcaagtccggcgca

SEQ ID NO: 11915 - DNA, 98 bp, Artificial
  mutant
gtcatccttgcattttgcaggcgccgtcctgagccgcgcggcctctccaaggtcctggtgcctgacggcgagagcgacgacttggcaagtccggcgca

SEQ ID NO: 11916 - DNA, 90 bp, Artificial
  mutant
gtcatccttgcattttgcaggcgccgtcctgagccgcgcggccgtcctggtgcctgacggcgagagcgacgacttggcaagtccggcgca

SEQ ID NO: 11917 - DNA, 105 bp, Artificial
  mutant
ctcatccttgcatttgcaggcgccgtcctgagccgcgcggcctctccaggggaaggtcctggtgcctgacggtgagagcgacgacttggcggccactccagcgca

SEQ ID NO: 11918 - DNA, 103 bp, Artificial
  mutant
ctcatccttgcatttgcaggcgccgtcctgagccgcgcggcctctccaggaaggtcctggtgcctgacggtgagagcgacgacttggcggccactccagcgca

SEQ ID NO: 11919 - DNA, 81 bp, Artificial
  mutant
gtcatccttgcattttgcaggcgccgtcctgagccgcgcggcgcctgacggcgagagcgacgacttggcaagtccggcgca

SEQ ID NO: 11920 - DNA, 41 bp, Artificial
  mutant
tcatccttgcattttgcaggcgccttcctaggggggaaatc

SEQ ID NO: 11921 - DNA, 96 bp, Artificial
  mutant
gtcatccttgcattgcaggcgccgtcctgagccgcgcggcctctccagggtcctggtgcctgacggtgagagcgacgacttggcaagtccggcgca

SEQ ID NO: 11922 - DNA, 93 bp, Artificial
  mutant
gtcatccttgcattgcaggcgccgtcctgagccgcgcggcctctccgtcctggtgcctgacggtgagagcgacgacttggcaagtccggcgca

SEQ ID NO: 11923 - DNA, 87 bp, Artificial
  mutant
gtcatccttgcattgcaggcgccgtcctgagccgcgcggcctcctggtgcctgacggtgagagcgacgacttggcaagtccggcgca

SEQ ID NO: 11924 - DNA, 78 bp, Artificial
  mutant
ttttctcactctttcttctgttcttgctgtaactgcaagttgtacacaccatcgtgccgggaaatcttcatacaatcg

SEQ ID NO: 11925 - DNA, 87 bp, Artificial
  mutant
ctcatccttgcatttgcaggcgccgtcctgagccgaggtcctggtgcctgacggtgagagcgacgacttggcggccactccagcgca

SEQ ID NO: 11926 - DNA, 96 bp, Artificial
  mutant
gtcatccttgcattttgcaggcgccgtcctgagccgcgcggcctctccagtcctggtgcctgacggcgagagcgacgacttggcaagtccggcgca

SEQ ID NO: 11927 - DNA, 94 bp, Artificial
  mutant
gtcatccttgcattttgcaggcgccgtcctgagccgcgcggcctctcgtcctggtgcctgacggcgagagcgacgacttggcaagtccggcgca

SEQ ID NO: 11928 - DNA, 89 bp, Artificial
  mutant
gtcatccttgcattttgcaggcgccgtcctgagccgcgcggcctctccgtgcctgacggcgagagcgacgacttggcaagtccggcgca

SEQ ID NO: 11929 - DNA, 88 bp, Artificial
  mutant
gtcatccttgcattttgcaggcgccgtcctgagccgcgcggcctctggtgcctgacggcgagagcgacgacttggcaagtccggcgca

SEQ ID NO: 11930 - DNA, 87 bp, Artificial
  mutant
gtcatccttgcattttgcaggcgccgtcctgagccgcgcggtcctggtgcctgacggcgagagcgacgacttggcaagtccggcgca

SEQ ID NO: 11931 - DNA, 96 bp, Artificial
  mutant
gtcatccttgcattgcaggcgccgtcctgagccgcgcggcctctccaaggtcctggtgcctgacggtgagagcgacgacttggcaagtccggcgca

SEQ ID NO: 11932 - DNA, 100 bp, Artificial
  mutant
ctcatccttgcatttgcaggcgccgtcctgagccgcgcggcctctccagggtcctggtgcctgacggtgagagcgacgacttggcggccactccagcgca

SEQ ID NO: 11933 - DNA, 94 bp, Artificial
  mutant
ctcatccttgcatttgcaggcgccgtcctgagccgcgcggcctctccctggtgcctgacggtgagagcgacgacttggcggccactccagcgca

SEQ ID NO: 11934 - DNA, 82 bp, Artificial
  mutant
ctcatccttgcatttgcaggcgccgtcctgagccgcgcggcctctacggtgagagcgacgacttggcggccactccagcgca

SEQ ID NO: 11935 - DNA, 91 bp, Artificial
  mutant
gtcatccttgcattttgcaggcgccgtcctgagccgcgcggcctctcctggtgcctgacggcgagagcgacgacttggcaagtccggcgca

SEQ ID NO: 11936 - DNA, 85 bp, Artificial
  mutant
gtcatccttgcattttgcaggcgccgtcctgagccgcgcggctggtgcctgacggcgagagcgacgacttggcaagtccggcgca

SEQ ID NO: 11937 - DNA, 77 bp, Artificial; identical to SEQ ID NO: 11910
  mutant
